US010517889B2

(12) United States Patent
Freier et al.

(10) Patent No.: US 10,517,889 B2
(45) Date of Patent: Dec. 31, 2019

(54) MODULATORS OF SMAD7 EXPRESSION

(71) Applicant: Ionis Pharmaceuticals, Inc., Carlsbad, CA (US)

(72) Inventors: Susan M. Freier, San Diego, CA (US); Huynh-Hoa Bui, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 16/124,583

(22) Filed: Sep. 7, 2018

(65) Prior Publication Data

US 2019/0076465 A1 Mar. 14, 2019

Related U.S. Application Data

(60) Provisional application No. 62/556,214, filed on Sep. 8, 2017.

(51) Int. Cl.
*A61K 31/712* (2006.01)
*A61K 31/7125* (2006.01)
*A61K 31/713* (2006.01)
*A61K 31/7115* (2006.01)
*A61P 1/00* (2006.01)
*A61P 37/00* (2006.01)
*A61K 31/7042* (2006.01)
*A61P 35/00* (2006.01)
*A61P 37/06* (2006.01)

(52) U.S. Cl.
CPC ...... *A61K 31/7125* (2013.01); *A61K 31/7042* (2013.01); *A61P 1/00* (2018.01); *A61P 35/00* (2018.01); *A61P 37/06* (2018.01)

(58) Field of Classification Search
None
See application file for complete search history.

(56) References Cited

U.S. PATENT DOCUMENTS

| | | |
|---|---|---|
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohtsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,185,444 A | 2/1993 | Summerton et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Summerton et al. |

(Continued)

FOREIGN PATENT DOCUMENTS

| | | | |
|---|---|---|---|
| WO | 2013037970 A1 | 3/2013 | |
| WO | 2015011694 A2 | 1/2015 | |
| WO | WO-2017059225 A1 * | 4/2017 | ........... C12N 15/113 |

OTHER PUBLICATIONS

Boirivant et al., "Inhibition of Smad7 With a Specific Antisense Oligonucleotide Facilitates TGF-?1-Mediated Suppression of Colitis" Gastroenterology (2006) 131: 1786-1798.
Bouma et al., "The immunological and genetic basis of inflammatory bowel disease" Nat. Rev. Immunol. (2003) 3: 521-533.
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.

(Continued)

*Primary Examiner* — Tracy Vivlemore
(74) *Attorney, Agent, or Firm* — Panitch Schwarze Belisario & Nadel LLP

(57) ABSTRACT

The present embodiments provide methods, compounds, and compositions useful for inhibiting SMAD7 expression, which may be useful for treating, preventing, or ameliorating a disease associated with SMAD7.

26 Claims, No Drawings
Specification includes a Sequence Listing.

(56) References Cited

U.S. PATENT DOCUMENTS

| | | |
|---|---|---|
| 5,405,939 A | 4/1995 | Suhadolnik et al. |
| 5,432,272 A | 7/1995 | Benner |
| 5,434,257 A | 7/1995 | Matteucci et al. |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Misiura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci et al. |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bischofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci et al. |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Buhr et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'o et al. |
| 6,005,087 A | 12/1999 | Cook et al. |
| 6,005,096 A | 12/1999 | Matteucci et al. |
| 6,159,697 A | 12/2000 | Monia et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,887,906 B1 | 5/2005 | Teng et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel |
| 7,101,993 B1 | 9/2006 | Cook et al. |
| 7,262,177 B2 | 8/2007 | Ts'O et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,576,067 B2 | 8/2009 | Weinbach et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Seth et al. |
| 7,750,131 B2 | 7/2010 | Seth et al. |
| 7,807,818 B2 | 10/2010 | Monteleone |
| 7,875,733 B2 | 1/2011 | Bhat et al. |
| 7,939,677 B2 | 5/2011 | Bhat et al. |
| 8,022,193 B2 | 9/2011 | Seth et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 8,912,154 B2 | 12/2014 | Baroni et al. |
| 9,005,906 B2 | 4/2015 | Swayze et al. |
| 9,012,421 B2 | 4/2015 | Migawa et al. |
| 9,127,276 B2 | 9/2015 | Prakash et al. |
| 9,290,760 B2 | 3/2016 | Rajeev et al. |
| 2001/0053519 A1 | 12/2001 | Fodor et al. |
| 2003/0049662 A1 | 3/2003 | Monia et al. |
| 2003/0082807 A1 | 5/2003 | Wengel |
| 2003/0158403 A1 | 8/2003 | Manoharan et al. |
| 2003/0175906 A1 | 9/2003 | Manoharan et al. |
| 2003/0207841 A1 | 11/2003 | Kaneko et al. |
| 2003/0224377 A1 | 12/2003 | Wengel et al. |
| 2003/0228597 A1 | 12/2003 | Cowsert et al. |
| 2004/0143114 A1 | 7/2004 | Imanishi et al. |
| 2004/0171570 A1 | 9/2004 | Allerson et al. |
| 2004/0192918 A1 | 9/2004 | Imanishi et al. |
| 2004/0229831 A1 | 11/2004 | Teng et al. |

(56) References Cited

U.S. PATENT DOCUMENTS

| | | | |
|---|---|---|---|
| 2005/0096284 A1* | 5/2005 | McSwiggen | A61K 49/0008 514/44 R |
| 2005/0130923 A1 | 6/2005 | Bhat et al. | |
| 2006/0148740 A1 | 7/2006 | Platenburg | |
| 2007/0031844 A1 | 2/2007 | Khvorova et al. | |
| 2008/0039618 A1 | 2/2008 | Allerson et al. | |
| 2010/0190837 A1 | 7/2010 | Migawa et al. | |
| 2010/0197762 A1 | 8/2010 | Swayze | |
| 2011/0123520 A1 | 5/2011 | Manoharan et al. | |
| 2011/0207795 A1 | 8/2011 | Steinbrecher et al. | |
| 2011/0288155 A1* | 11/2011 | Feinstein | C12N 15/1137 514/44 A |
| 2013/0053430 A1* | 2/2013 | Bell, III | C12N 15/113 514/44 A |
| 2013/0130378 A1 | 5/2013 | Manoharan et al. | |
| 2013/0203836 A1 | 8/2013 | Rajeev et al. | |
| 2014/0107330 A1 | 4/2014 | Freier et al. | |
| 2015/0018540 A1 | 1/2015 | Prakash et al. | |
| 2015/0184153 A1 | 7/2015 | Freier et al. | |
| 2015/0191727 A1 | 7/2015 | Migawa et al. | |
| 2015/0232836 A1 | 8/2015 | Krieg et al. | |
| 2015/0232854 A1 | 8/2015 | Baroni et al. | |
| 2015/0267195 A1 | 9/2015 | Seth et al. | |
| 2015/0275212 A1 | 10/2015 | Albaek et al. | |

OTHER PUBLICATIONS

Crooke, "Routes and Formulations for Delivery of Antisense" Antisense Drug Technology, Second Edition (2008) p. 225-233.

Kulkarni et al., "Transforming growth factor-beta 1 knockout mice. A mutation in one cytokine gene causes a dramatic inflammatory disease" Am. J. Pathol. (1993) 143: 3-9.

Marafini et al., "Smad7 Sustains Inflammation in the Gut: From Bench to Bedside" J Clin Cell Immunol (2014) 5: 1-5.

Monteleone et al., "Blocking Smad7 restores TGF-β1- signaling in chronic inflammatory bowel disease" The Journal of Clinical Investigation (2001) 108(4): 601-609.

Monteleone et al. "TGF-beta1 and Smad7 in the regulation of IBD" Mucosal Immunol. (2008) 1: S50-S53.

Monteleone et al., "Mongersen, an oral SMAD7 antisense oligonucleotide, and Crohn's disease" N Engl J Med (2015) 372(12): 1104-1113.

Nakao et al. "Identification of Smad7, a TGFbeta-inducible antagonist of TGF-beta signalling" Nature (1997) 389: 631-635.

New England Biolabs 1998/99 Catalog (cover page and pp. 121 and 284).

Raoof et al., "Oral Bioavailability and Multiple Dose Tolerability of an Antisense Oligonucleotide Tablet Formulated with Sodium Caprate" Journal of Pharmaceutical Sciences (2004) 93(6): 1431-1439.

Reynolds et al., "Rational siRNA design for RNA interference" Nature Biotechnology (2004) 22(3):326-330.

Sedda et al., "High Smad7 sustains inflammatory cytokine response in refractory coeliac disease" Immunology (2017) 150: 356-363.

Ulloa et al., "Inhibition of transforming growth factor-β/SMAD signalling by the interferon-γ/STAT pathway" Nature (1999) 397: 710-713.

Sanghvi et al., "Heterocyclic Base Modifications in Nucleic Acids and Their Applications in Antisense Oligonucleotides" Antisense Research and Applications (1993) pp. 273-288.

Wikberg et al., "Review article: Targeted drug delivery in treatment of intestinal diseases" Aliment Pharmacol Ther (1997) 11(3): 109-115.

Woolf et al., "Specificity of antisense oligonucleotides in vivo" Proc. Natl. Acad. Sci., vol. 89, pp. 7305-7309, Aug. 1992.

Gautschi et al., "Activity of a Novel bcl-2/bcl-xL-Bispecific Antisense Oligonucleotide Against Tumors of Diverse histologic Origins" Journal of the National cancer Institute, vol. 93, No. 6, Mar. 2001.

Maher et al., "Comparative hybrid arrest by tandem antisense oligodexyribonucleotides or oligodeoxy-ribonucleoside rnethylphosphonates in a cell-free system" Nucleic Acids Research, vol. 16, No. 8, 1988.

Seth et al., "Short Antisense Oligonucleotides with novel 2"-4" Conformationaly Restricted Nucleoside Analogues Show Improved Potency without Increased Toxicity in Animals" J. Med. Chem, vol. 52, pp. 10-13, 2009.

Egli et al., "Synthesis, Improved Antisense Activity and Structural Rationale for the Divergent RNA Affinities of 3'-Fluoro Hexitol Nucleic Acid (FHNA and Ara-FHNA) Modified Oligonucleotides", J Am Chem Soc. 133(41): pp. 16642-16649, Oct. 2011.

Crooke et al., "Mechanisms of Antisense Drug Action, an Introduction", Antisense Drug Technology, Chapters 1-28 (414 pages), 2008.

Int'l Search Report and Written Opinion dated Jan. 28, 2019 in Int'l Application PCT/US2018/49867.

* cited by examiner

MODULATORS OF SMAD7 EXPRESSION

CROSS-REFERENCE TO RELATED APPLICATION

This application claims the benefit of priority to U.S. Provisional Application No. 62/556,214, filed Sep. 8, 2017, the disclosure of which is incorporated herein by reference in its entirety.

SEQUENCE LISTING

The present application is being filed along with a Sequence Listing in electronic format. The Sequence Listing is provided as a file entitled BIOL0295USLSEQ_ST25.txt created Sep. 5, 2017, which is 601 kb in size. The information in the electronic format of the sequence listing is incorporated herein by reference in its entirety.

FIELD

The present embodiments provide methods, compounds, and compositions useful for inhibiting Mothers Against Decapenta-plegic, Drosophila, Homolog 7 (SMAD7; also known as MADH7, MADH8, MAD homolog 7) expression, and in certain instances, reducing the amount of SMAD7 protein in a cell or animal, which can be useful for treating, preventing, or ameliorating a disease, disorders, or syndromes associated with SMAD7.

BACKGROUND

Inflammatory bowel diseases (IBDs) are caused by an aberrant and excessive local immune response to components of bacterial microflora (Bouma G and Strober W. Nat. Rev. Immunol. 3: 521-533, 2003) and is controlled by regulatory molecules, including TGF-beta1 (Kulkarni A. B. and Karlsson, S. Am. J. Pathol. 143: 3-9, 1993). Disruption of TGF-beta1 signaling occurs in IBDs by the upregulation of the intracellular inhibitor of Smad signaling, Smad7 (Nakao A et al. Nature 389: 631-635, 1997); one of the main pathological processes involved in the tissue-destructive inflammatory response of IBDs in humans. Therefore, therapeutics that reduce Smad7 protein or function may restore TGF-beta1 signaling and reset immune homeostasis.

The current standard of medical care for Crohn's disease and ulcerative colitis, the two major forms of inflammatory bowel disease in humans, involves treatment with anti-inflammatory agents, corticosteroids, immunomodulators, including azathioprine, or its active metabolite 6-mercaptopurine, methotrexate, biologic agents, including tumor necrosis factor antagonist therapies, anti-integrin therapies, and anti-interleukin (IL) $12/23$ therapy. Recently, antisense inhibition of Smad7 by a morpholino oligonucleotide in animal models as well as in patients with Crohn's disease has been demonstrated (Monteleone et al. Mucosal Immunol. 1: S50-S53, 2008; Monteleone et al. N. Engl. J. Med. 372: 1104-1113, 2015). It is an object herein to provide compounds and compositions of high efficacy and tolerability for the treatment of diseases disclosed herein.

SUMMARY

Certain embodiments provided herein are compounds and methods for reducing the amount or activity of SMAD7 mRNA and, in certain embodiments, reducing the amount of SMAD7 protein in a cell or animal. In certain embodiments, the animal has a gastrointestinal disease. In certain embodiments, the disease is Crohn's disease. In certain embodiments, the disease is inflammatory bowel disease (IBD). In certain embodiments, the disease is ulcerative colitis. In certain embodiments, the disease is pouchitis. In certain embodiments, the disease is celiac disease. In certain embodiments, the disease is intestinal GVHD. In certain embodiments, the disease is cancer therapy-indiced colitis. Certain compounds provided herein are directed to compounds and compositions that reduce inflammation in an animal.

Certain embodiments provided herein are directed to potent and tolerable compounds and compositions useful for inhibiting SMAD7 expression, which can be useful for treating, preventing, ameliorating, or slowing progression of a gastrointestinal disease. Certain embodiments provided herein are directed to compounds and compositions that are more potent or have greater therapeutic value than compounds publicly disclosed. Certain embodiments provided herein are directed to compounds and compositions that exhibit higher stability leading to increased tissue resident time and uptake compared to compounds publicly disclosed.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

DEFINITIONS

Unless otherwise indicated, the following terms have the following meanings:

"2'-deoxynucleoside" means a nucleoside comprising 2'-H(H) ribosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE) refers to a 2'-O (CH$_2$)$_2$—OCH$_3$ group in the place of the 2'-OH group of a ribosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within ±10% of a value. For example, if it is stated, "the compounds affected about 70% inhibition of SMAD7", it is implied that SMAD7 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a ribosyl bicyclic sugar moiety wherein the second ring of the bicyclic sugar is formed via a bridge connecting the 4'-carbon and the 2'-carbon, wherein the bridge has the formula: 4'-CH($CH_3$)—O-2', and wherein the methyl group of the bridge is in the S configuration.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound.

Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating SMAD7 RNA can mean to increase or decrease the level of SMAD7 RNA and/or SMAD7 protein in a cell, tissue, organ or organism. A "modulator" effects the change in the cell, tissue, organ or organism. For example, a SMAD7 compound can be a modulator that decreases the amount of SMAD7 RNA and/or SMAD7 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide. "Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"SMAD7" means any nucleic acid or protein of SMAD7. "SMAD7 nucleic acid" means any nucleic acid encoding SMAD7. For example, in certain embodiments, a SMAD7 nucleic acid includes a DNA sequence encoding SMAD7, an RNA sequence transcribed from DNA encoding SMAD7 (including genomic DNA comprising introns and exons), and an mRNA sequence encoding SMAD7. "SMAD7 mRNA" means an mRNA encoding a SMAD7 protein. The target may be referred to in either upper or lower case.

"SMAD7 specific inhibitor" refers to any agent capable of specifically inhibiting SMAD7 RNA and/or SMAD7 protein expression or activity at the molecular level. For example, SMAD7 specific inhibitors include nucleic acids (including antisense compounds), peptides, antibodies, small molecules, and other agents capable of inhibiting the expression of SMAD7 RNA and/or SMAD7 protein.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof "Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) ribosyl moiety, as found in RNA (an "unmodified RNA sugar moiety"), or a 2'-H(H) moiety, as found in DNA (an "unmodified DNA sugar moiety"). "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen or hydroxyl of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

Certain Embodiments

Certain embodiments provide methods, compounds and compositions for inhibiting Mothers Against Decapentaplegic, *Drosophila*, Homolog 7 (SMAD7) expression.

Certain embodiments provide compounds targeted to a SMAD7 nucleic acid. In certain embodiments, the SMAD7 nucleic acid has the sequence set forth in RefSeq or GENBANK Accession No. NM_005904.3 (incorporated by reference, disclosed herein as SEQ ID NO: 1), complement of NT_010966.15 truncated from nucleotides 28007000 to 28041000 (incorporated by reference, disclosed herein as SEQ ID NO: 2), NM_001190823.1 (incorporated by reference, disclosed herein as SEQ ID NO: 3), NM 001190822.1 (incorporated by reference, disclosed herein as SEQ ID NO: 4), NM_001190821.1 (incorporated by reference, disclosed herein as SEQ ID NO: 5), AF015261.1 (incorporated by reference, disclosed herein as SEQ ID NO: 6), and AF010193.1 (incorporated by reference, disclosed herein as SEQ ID NO: 7). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 9 to 80 linked nucleosides in length and having a nucleobase sequence comprising at least 9 contiguous nucleobases of any of the nucleobase sequences of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 10 to 80 linked nucleosides in length and having a nucleobase sequence comprising at least 10 contiguous nucleobases of any of the nucleobase sequences of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 11 to 80 linked nucleosides in length and having a nucleobase sequence comprising at least 11 contiguous nucleobases of any of the nucleobase sequences of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 11 to 30 linked nucleosides in length.

Certain embodiments provide a compound comprising a modified oligonucleotide 12 to 80 linked nucleosides in length and having a nucleobase sequence comprising at least 12 contiguous nucleobases of any of the nucleobase sequences of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 12 to 30 linked nucleosides in length.

In certain embodiments, the compound comprises a modified oligonucleotide 16 linked nucleosides in length. In certain embodiments, the compound is an antisense compound or oligomeric compound.

Certain embodiments provide a compound comprising a modified oligonucleotide 16 to 80 linked nucleosides in length and having a nucleobase sequence comprising the nucleobase sequence of any one of SEQ ID NOs: 14-2735. In certain embodiments, the compound is an antisense compound or oligomeric compound. In certain embodiments, the compound is single-stranded. In certain embodiments, the compound is double-stranded. In certain embodiments, the modified oligonucleotide is 16 to 30 linked nucleosides in length.

Certain embodiments provide a compound comprising a modified oligonucleotide consisting of the nucleobase sequence of any one of SEQ ID NOs: 14-2735. In certain embodiments, the compound is an antisense compound or oligomeric compound. In certain embodiments, the compound is single-stranded. In certain embodiments, the compound is double-stranded.

In certain embodiments, compounds target nucleotides 1514-1539, 1632-1648, 1670-1686, 1713-1734, 1723-1739, 1728-1755, 1763-1813, 1911-1930, 1987-2022, 2069-2086, 2072-2089, 2115-2133, 2146-2162, 2224-2241, 2228-2245, 2234-2271, 2278-2294, 2281-2304, 2293-2313, 2296-2312, 2314-2334, 2314-2332, 2344-2362, 2494-2557, 2495-2554, 2498-2557, 2505-2546, 2508-2545, 2515-2556, 2904-2922, 3609-3627, 3641-3667, 3641-3657, 3666-3682, 3784-3801, 4142-4159, 4149-4169, 4199-4226, 4630-4655, 4866-4924, 4980-5038, 4996-5038, 5076-5093, 5248-5278, 5557-5581, 5558-5575, 5574-5593, 5581-5600, 5607-5625, 5956-5997, 6279-6301, 6416-6437, 6724-7041, 7022-7144, 7362-7436, 7766-7782, 8125-8141, 8750-8783, 9179-9231, 9407-9426, 9447-9464, 9452-9468, 9547-9571, 9644-9665, 9821-9870, 10020-10056, 10275-10290, 10277-10293, 10386-10417, 10811-10914, 10897-10914, 11124-11140, 11230-11246, 11759-11892, 11976-12008, 12019-12052, 12207-12261, 12501-12519, 12558-12574, 12619-12635, 12745-12788, 12942-12962, 13234-13259, 13243-13265, 13668-13714, 13778-13824, 13992-14043, 13995-14014, 14268-14387, 14518-14584, 14839-15040, 15647-15666, 15678-15777, 15847-15925, 16762-16810, 16898-16921, 16922-16960, 17155-17178, 17537-17581, 17588-17612, 17892-18007, 18021-18046, 18342-18396, 18456-18478, 19007-19027, 20650-20673, 20728-20758, 21139-21291, 22029-22116, 23268-23319, 24476-24499, 25501-25517, 26677-26698, 27028-27046, 27084-27101, 28191-28207, 28269-28312, 28301-28320, 28700-28768, 29276-29293, 29525-29541, 30320-30337, 30447-30464, 30584-30600, 30689-30727, 30753-30782, 30854-30872, 30864-30882, 30890-30908, 30993-31011, 31119-31137, 31141-31159, 31213-31238, 31294-31347, 31717-31738, 31739-31757, 31769-31787, 31819-31842, 31829-31845, 31887-31904, 31898-31914, 31913-31931, 31992-32008, 31998-32013, 32006-32022, 32026-32041 of a SMAD7 nucleic acid having the nucleobase sequence of SEQ ID NO: 2. In certain embodiments, the compound is at least 85%, at least 90%, at least 95%, or 100% complementary to SEQ ID NO: 2. In certain embodiments, the compound is an antisense compound or oligomeric compound. In certain embodiments, the compound is single-stranded. In certain embodiments, the compound is double-stranded.

In certain embodiments, compounds have at least an 8, 9, 10, 11, 12, 13, 14, 15, or 16 contiguous nucleobase portion complementary to an equal length portion within nucleotides 1514-1539, 1632-1648, 1670-1686, 1713-1734, 1723-1739, 1728-1755, 1763-1813, 1911-1930, 1987-2022, 2069-2086, 2072-2089, 2115-2133, 2146-2162, 2224-2241, 2228-2245, 2234-2271, 2278-2294, 2281-2304, 2293-2313, 2296-2312, 2314-2334, 2314-2332, 2344-2362, 2494-2557, 2495-2554, 2498-2557, 2505-2546, 2508-2545, 2515-2556, 2904-2922, 3609-3627, 3641-3667, 3641-3657, 3666-3682, 3784-3801, 4142-4159, 4149-4169, 4199-4226, 4630-4655, 4866-4924, 4980-5038, 4996-5038, 5076-5093, 5248-5278, 5557-5581, 5558-5575, 5574-5593, 5581-5600, 5607-5625, 5956-5997, 6279-6301, 6416-6437, 6724-7041, 7022-7144, 7362-7436, 7766-7782, 8125-8141, 8750-8783, 9179-9231, 9407-9426, 9447-9464, 9452-9468, 9547-9571, 9644-9665, 9821-9870, 10020-10056, 10275-10290, 10277-10293, 10386-10417, 10811-10914, 10897-10914, 11124-11140, 11230-11246, 11759-11892, 11976-12008, 12019-12052, 12207-12261, 12501-12519, 12558-12574, 12619-12635, 12745-12788, 12942-12962, 13234-13259, 13243-13265, 13668-13714, 13778-13824, 13992-14043, 13995-14014, 14268-14387, 14518-14584, 14839-15040, 15647-15666, 15678-15777, 15847-15925, 16762-16810, 16898-16921, 16922-16960, 17155-17178, 17537-17581, 17588-17612, 17892-18007, 18021-18046, 18342-18396, 18456-18478, 19007-19027, 20650-20673, 20728-20758, 21139-21291, 22029-22116, 23268-23319, 24476-24499, 25501-25517, 26677-26698, 27028-27046, 27084-27101, 28191-28207, 28269-28312, 28301-28320, 28700-28768, 29276-29293, 29525-29541, 30320-30337, 30447-30464, 30584-30600, 30689-30727, 30753-30782, 30854-30872, 30864-30882, 30890-30908, 30993-31011, 31119-31137, 31141-31159, 31213-31238, 31294-31347, 31717-31738, 31739-31757, 31769-31787, 31819-31842, 31829-31845, 31887-31904, 31898-31914, 31913-31931, 31992-32008, 31998-32013, 32006-32022, 32026-32041 of a SMAD7 nucleic acid having the nucleobase sequence of SEQ ID NO: 2. In certain embodiments, the compound is at least 85%, at least 90%, at least 95%, or 100% complementary to SEQ ID NO: 2. In certain embodiments, the compound is single-stranded. In certain embodiments, the compound is double-stranded. In certain embodiments, these compounds are antisense compounds, oligomeric compounds, or oligonucleotides.

In certain embodiments, compounds target a region of a SMAD7 nucleic acid having the nucleobase sequence of SEQ ID NO: 1 within nucleobases 19-44, 175-191, 218-239, 233-260, 268-318, 416-435, 496-431, 574-591, 577-594, 620-638, 651-667, 729-746, 733-750, 739-776, 783-799, 789-809, 798-818, 819-839, 849-867, 892-908, 977-1028, 1052-1069, 1192-1210, 1317-1333, 1440-1460, 1486-1515, 1597-1615, 1623-1641, 1726-1744, 1852-1870, 1874-1895, 1946-1971, 2027-2080, 2439-2459, 2450-2471, 2472-2490, 2502-2520, 2552-2575, 2562-2578, 2620-2637, 2631-2647, 2646-2664, 2725-2741, 2731-2746, or 2739-2755. In certain embodiments, compounds target at least an 8, 9, 10, 11, 12, 13, 14, 15, or 16 contiguous nucleobases within the aforementioned nucleobase regions. In certain embodiments, the compound is at least 85%, at least 90%, at least 95%, or 100% complementary to SEQ ID NO: 1. In certain embodiments, the compound is single-stranded. In certain embodiments, the compound is double-stranded. In certain embodiments, these compounds are antisense compounds, oligomeric compounds, or oligonucleotides.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within nucleotides 2317-2332, 3641-3656, 5023-5038, 5559-5574, 12558-12573, or 31998-32013 of SEQ ID NO: 2. In certain embodiments, the modified oligonucleotide is 10 to 30 linked nucleosides in length.

In certain embodiments, a compound comprises a modified oligonucleotide 8 to 80 linked nucleosides in length and complementary within nucleotides 2317-2332, 3641-3656, 5023-5038, 5559-5574, 12558-12573, or 31998-32013 of SEQ ID NO: 2. In certain embodiments, the modified oligonucleotide is 10 to 30 linked nucleosides in length.

In certain embodiments, a compound comprises a modified oligonucleotide 8 to 80 linked nucleosides in length and having a nucleobase sequence comprising at least an 8, 9, 10, 11, 12, 13, 14, 15, or 16 contiguous nucleobase portion any one of SEQ ID NOs: 1456, 2109, 2506, 2537, 2548, or 2633. In certain embodiments, the modified oligonucleotide is 10 to 30 linked nucleosides in length.

In certain embodiments, a compound comprises a modified oligonucleotide 8 to 80 linked nucleosides in length and having a nucleobase sequence comprising any one of SEQ ID NOs: 1456, 2109, 2506, 2537, 2548, or 2633. In certain embodiments, the modified oligonucleotide is 10 to 30 linked nucleosides in length.

In certain embodiments, a compound comprises a modified oligonucleotide having a nucleobase sequence consisting of any one of SEQ ID NOs: 1456, 2109, 2506, 2537, 2548, or 2633.

In certain embodiments, the compound is at least 85%, at least 90%, at least 95%, or 100% complementary to SEQ ID NO: 2. In certain embodiments, the compound is single-stranded. In certain embodiments, the compound is double-stranded. In certain embodiments, these compounds are antisense compounds, oligomeric compounds, or oligonucleotides.

In certain embodiments, a compound targeted to SMAD7 is ION 830025. Out of over 2,720 compounds that were screened as described in the Examples section below, ION 830121, ION 829994, ION 830037, ION 798781, ION 790615, and ION 830025 emerged as the top lead compounds. In particular, ION 830025 exhibited the best combination of properties in terms of potency and tolerability out of over 2,720 compounds.

In certain embodiments, any of the foregoing modified oligonucleotides comprises at least one modification selected from at least one modified internucleoside linkage, at least one modified sugar, and at least one modified nucleobase.

In certain embodiments, any of the foregoing modified oligonucleotides comprises at least one modified sugar. In certain embodiments, at least one modified sugar comprises a 2'-O-methoxyethyl group. In certain embodiments, at least one modified sugar is a bicyclic sugar, such as a 4'-CH(CH3)-O-2' group, a 4'-CH2-O-2' group, or a 4'-(CH2)2-O-2' group.

In certain embodiments, the modified oligonucleotide comprises at least one modified internucleoside linkage, such as a phosphorothioate internucleoside linkage.

In certain embodiments, any of the foregoing modified oligonucleotides comprises at least one modified nucleobase, such as 5-methylcytosine.

In certain embodiments, any of the foregoing modified oligonucleotides comprises:
a gap segment consisting of linked deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide is 16 to 80 linked nucleosides in length having a nucleobase sequence comprising the sequence recited in any one of SEQ ID NO: 1456, 2109, 2506, 2537, 2548, or 2633. In certain embodiments, the modified oligonucleotide is 16 to 30 linked nucleosides in length having a nucleobase sequence comprising the sequence recited in any one of SEQ ID NOs: 1456, 2109, 2506, 2537, 2548, or 2633. In certain embodiments, the modified oligonucleotide is 16 linked nucleosides in length having a nucleobase sequence consisting of the sequence recited in any one of SEQ ID NOs: 1456, 2109, 2506, 2537, 2548, or 2633.

In certain embodiments, a compound comprises or consists of a modified oligonucleotide 16-80 linked nucleobases in length having a nucleobase sequence comprising the sequence recited in any one of SEQ ID NOs: 1456, 2109, 2506, 2537, 2548, or 2633, wherein the modified oligonucleotide comprises a gap segment consisting often linked deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt sugar; wherein at least one internucleoside linkage is a phosphorothioate linkage; and wherein each cytosine is a 5-methylcytosine. In certain embodiments, the modified oligonucleotide is 16-80 linked nucleosides in length. In certain embodiments, the modified oligonucleotide is 16-30 linked nucleosides in length.

In certain embodiments, a compound comprises or consists of ION 830025 or salt thereof, having the following chemical structure:

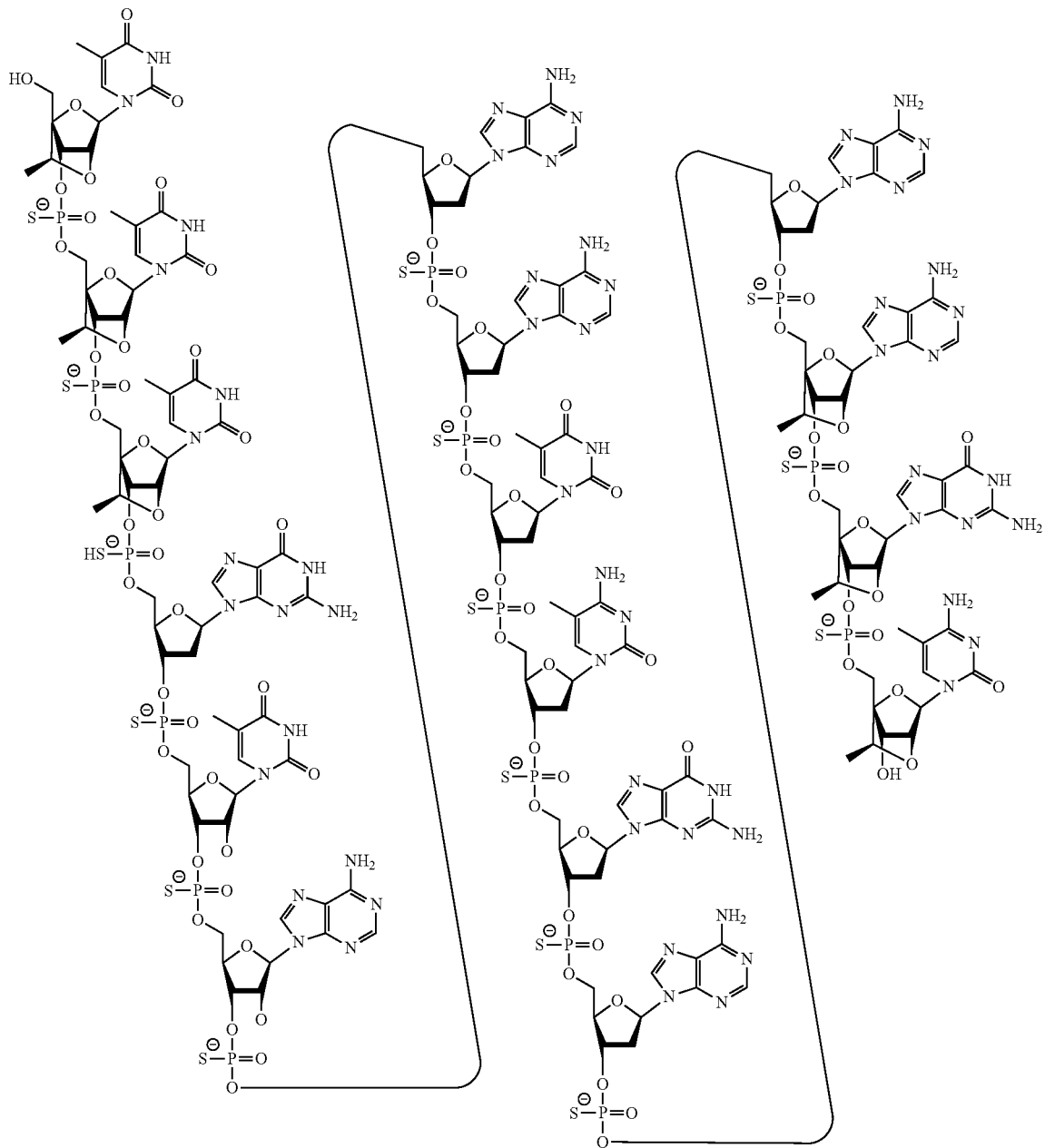

In certain embodiments, a compound comprises or consists of the sodium salt of ION 830025, having the following chemical structure:
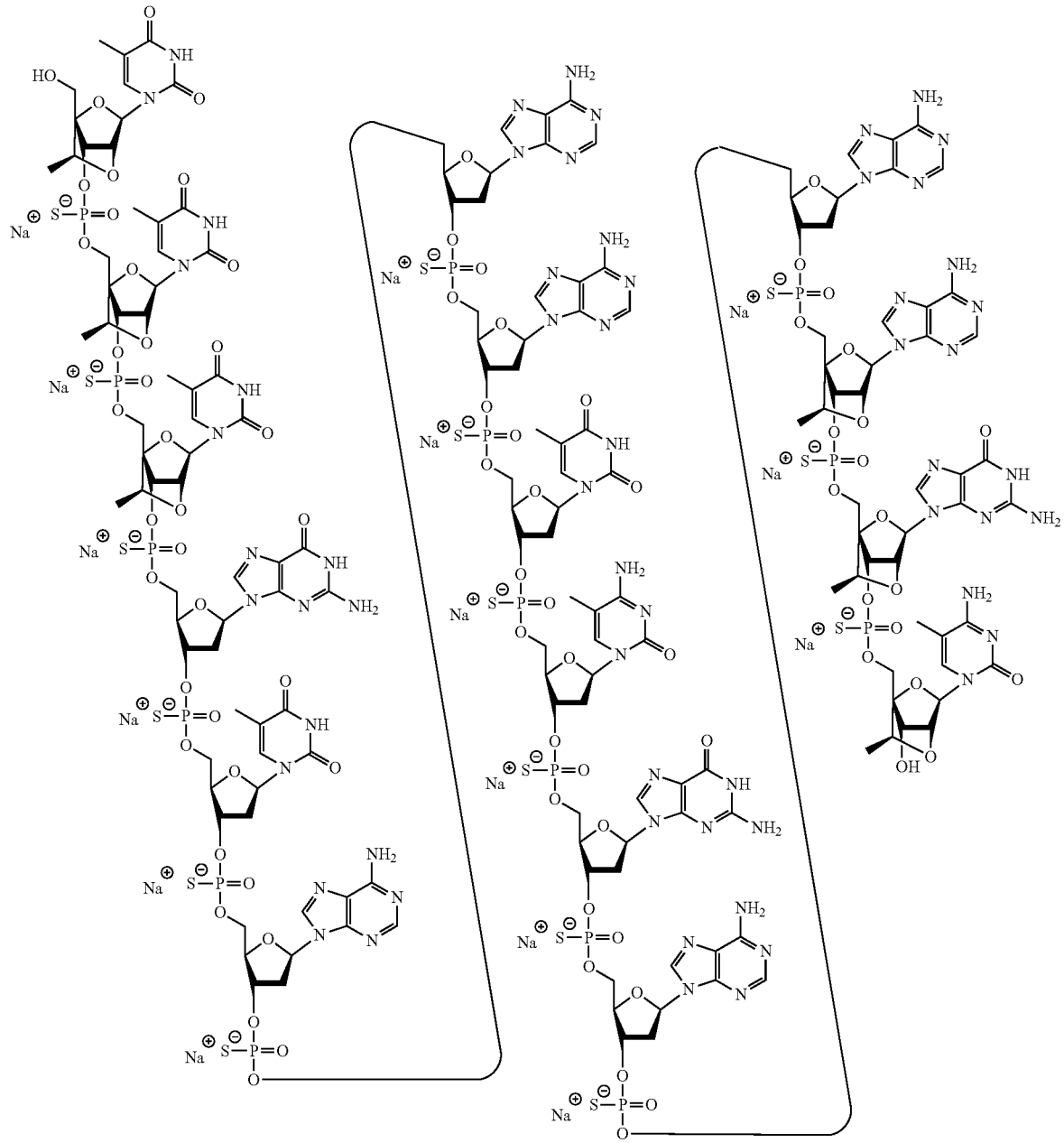

In certain embodiments, a compound comprises or consists of ION 798781 or salt thereof, having the following chemical structure:
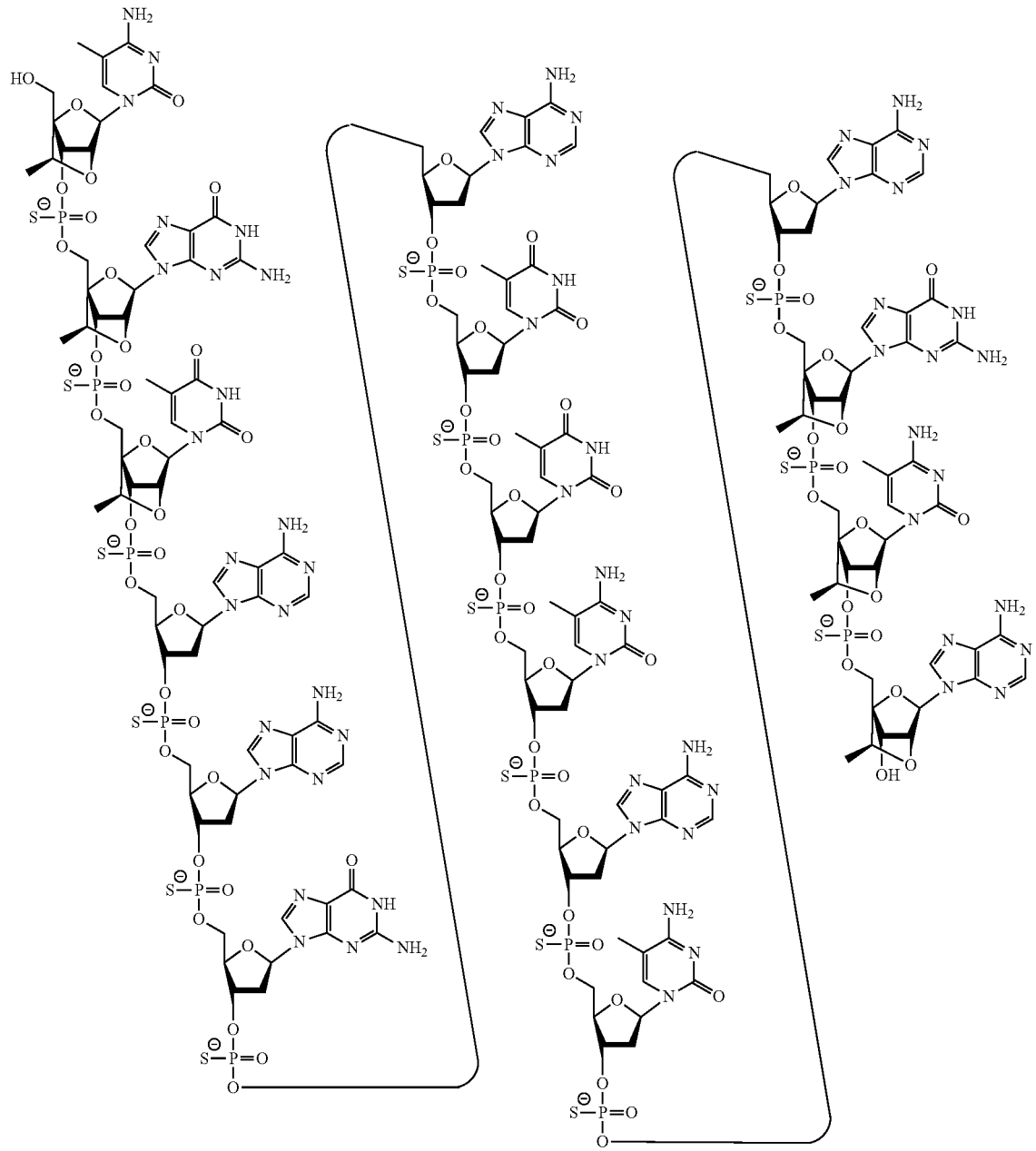

In certain embodiments, a compound comprises or consists of the sodium salt of ION 798781, having the following chemical structure:

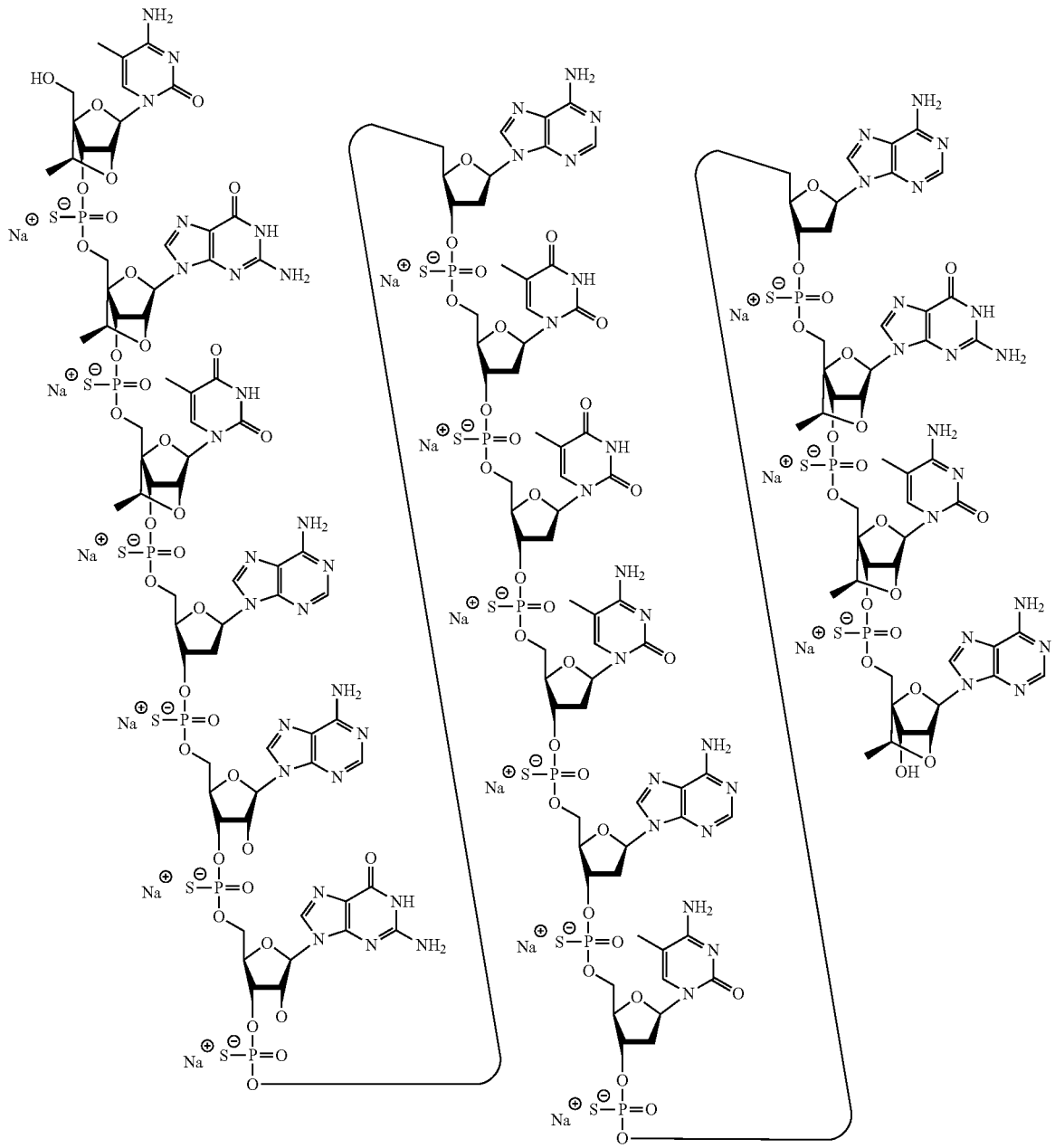

In any of the foregoing embodiments, the compound or oligonucleotide can be at least 85%, at least 90%, at least 95%, at least 98%, at least 99%, or 100% complementary to a nucleic acid encoding SMAD7.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can be 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides in length. In certain embodiments, the compound comprises or consists of an oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are active by virtue of having at least one of an in vitro $IC_{50}$ of less than 20 μM, less than 15 μM, less than 10 μM, less than 5 μM, less than 1 μM, less than 900 nM, less than 800 nM, less than 700 nM, less than 600 nM, less than 500 nM, less than 400 nM, less than 300 nM, less than 200 nM, less than 100 nM, or less than 50 nM.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Certain Indications

Certain embodiments provided herein relate to methods comprising administering a compound or composition to an individual. Certain embodiments provided herein relate to methods of inhibiting SMAD7 expression, which can be useful for treating, preventing, or ameliorating a disease associated with SMAD7 in an individual, by administration of a compound that targets SMAD7. In certain embodiments, the compound can be a SMAD7 specific inhibitor. In certain embodiments, the compound can be an antisense compound, oligomeric compound, or oligonucleotide targeted to SMAD7.

Examples of diseases associated with SMAD7 treatable, preventable, and/or ameliorable with the methods provided herein include inflammatory bowel disease, pouchitis, celiac disease, intestinal graft-versus-host disease (GVHD) and cancer therapy-induced colitis.

Inflammatory bowel disease (IBD) is characterized by chronic inflammation in all or part of the digestive tract. It includes ulcerative colitis and Crohn's disease, both of which involve intestinal inflammation, disruption of the epithelial barrier, dysbiosis, severe diarrhea, pain, fatigue, abdominal cramping, reduced appetite, and weight loss. In certain embodiments, the diseases associated with SMAD7 are ulcerative colitis and Crohn's disease. Crohn's disease is an inflammatory bowel disease that causes inflammation in the lining of the digestive tract. The most common areas affected are the ileum and colon. Inflammation may be confined to the bowel wall, which can lead to narrowing from inflammation or scarring or both (fibrostenosis), or may tunnel through the bowel wall (fistula). Narrowing may lead to a blockage (obstruction). Ulcerative colitis is an inflammatory bowel disease that causes long-lasting inflammation and sores or ulcers in the innermost lining of the large intestine (colon) and rectum. Ulcerative colitis is classified according to location of the inflammation and severity of symptoms: (a) ulcerative proctitis, with inflammation confined to the area closest to the anus (rectum) and rectal bleeding may be the only sign of the disease; (b) proctosigmoiditis with inflammation in the rectum and sigmoid colon (lower end of the colon). Symptoms include bloody diarrhea, abdominal cramps and pain, and an inability to move the bowels inspite of the urge to do so (tenesmus); (c) Left-sided colitis, with inflammation extending from the rectum up through the sigmoid and descending colon. Symptoms include bloody diarrhea, abdominal cramping, and pain on the left side, and unintended weight loss; (d) Pancolitis, which affects the entire colon and causes bouts of bloody diarrhea that may be severe, abdominal cramps and pain, fatigue, and significant weight loss; and (e) Acute severe ulcerative colitis, previously called fulminant colitis. This rare form of colitis causes severe pain, profuse diarrhea, bleeding, fever, and inability to eat. In certain embodiments, the diseases associated with SMAD7 are ulcerative colitis and Crohn's disease.

Pouchitis is inflammation of the ileal pouch, an artificial rectum surgically created out of ileal gut tissue in patients that have undergone colectomy or proctocolectomy. The pouch is created in the management of patients with ulcerative colitis, indeterminate colitis, familial adenomatous polyposis, or other disorders. The inflammation can cause increased bowel frequency, abdominal cramping or bloating, lower abdominal pain, tenesmus or painful spasms of the anal sphincter, and/or blood in the stool. In certain embodiments, the disease associated with SMAD7 is pouchitis.

Celiac disease is a serious autoimmune disorder that can occur in genetically predisposed people where the ingestion of gluten leads to damage in the small intestine. Digestive symptoms common in patients include abdominal bloating and pain, chronic diarrhea, vomiting, constipation, weight loss, fatigue, unexplained iron-deficiency anemia, bone or joint pain, osteoporosis, liver and biliary tract disorders, or/and irritability. A recent study in patients with refractory celiac disease demonstrated the role of SMAD7 in the progression of the disease (Sedda S. et al., Immunology. 2017. 150: 356-363). In certain embodiments, the disease associated with SMAD7 is celiac disease.

In certain embodiments, a method of treating, preventing, or ameliorating a disease associated with SMAD7 in an individual comprises administering to the individual a compound comprising a SMAD7 specific inhibitor, thereby treating, preventing, or ameliorating the disease. In certain embodiments, the individual is identified as having or at risk of having a disease associated with SMAD7. In certain embodiments, the disease is a gastrointestinal disease. In certain embodiments, the compound comprises an antisense compound targeted to SMAD7. In certain embodiments, the compound comprises an oligonucleotide targeted to SMAD7. In certain embodiments, a compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, a compound comprises a modified oligonucleotide 12 to 80 linked nucleosides in length and having a nucleobase sequence comprising the nucleobase sequence of any one of SEQ ID NOs: 14-2735. In certain embodiments, a compound comprises a modified oligonucleotide consisting of the nucleobase sequence of any one of SEQ ID NOs: 14-2735. In certain embodiments, a compound comprises a modified oligonucleotide 12 to 80 linked nucleosides in length having a nucleobase sequence comprising any one of SEQ ID NOs: 1456, 2109, 2506, 2537, 2548, or 2633. In certain embodiments, a compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents inflammation in the gastrointestinal tract.

In certain embodiments, a method of treating, preventing, or ameliorating inflammation in the gastrointestinal tract, treating, preventing, or ameliorating diarrhea, treating, preventing, or ameliorating pain, treating, preventing, or ameliorating fatigue, treating, preventing, or ameliorating abdominal cramping, treating, preventing, or ameliorating blood in the stool, treating, preventing, or ameliorating intestinal inflammation, treating, preventing, or ameliorating disruption of the epithelial barrier of the gastrointestinal tract, treating, preventing, or ameliorating dysbiosis, treating, preventing, or ameliorating increased bowel frequency, treating, preventing, or ameliorating tenesmus or painful spasms of the anal sphincter, treating, preventing, or ameliorating constipation, or treating, preventing, or ameliorating unintended weight loss in an individual comprises administering to the individual a compound comprising a SMAD7 specific inhibitor. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a disease associated with SMAD7.

In certain embodiments, a method of inhibiting expression of SMAD7 in an individual having, or at risk of having, a disease associated with SMAD7 comprises administering to the individual a compound comprising a SMAD7 specific inhibitor, thereby inhibiting expression of SMAD7 in the individual. In certain embodiments, administering the compound inhibits expression of SMAD7 in gastrointestinal tissue. In certain embodiments, administering the compound inhibits expression of SMAD7 in the ileum. In certain embodiments, administering the compound inhibits expression of SMAD7 in the rectum. In certain embodiments, administering the compound inhibits expression of SMAD7 in colon. In certain embodiments, administering the compound inhibits expression of SMAD7 in the sigmoid colon. In certain embodiments, administering the compound inhibits expression of SMAD7 in the descending colon. In certain embodiments, the individual has, or is at risk of having inflammatory bowel disease. In certain embodiments, the individual has, or is at risk of having ulcerative colitis. In certain embodiments, the individual has, or is at risk of having Crohn's disease. In certain embodiments, the individual has indeterminate colitis. In certain embodiments, the individual has familial adenomatous polyposis. In certain embodiments, the individual has intestinal GvHD. In certain embodiments, the individual has cancer therapy-induced colitis. In certain embodiments, the individual has, or is at risk of having diarrhea. In certain embodiments, the individual has, or is at risk of having pain and fatigue. In certain embodiments, the individual has, or is at risk of having abdominal cramping. In certain embodiments, the individual has, or is at risk of having blood in the stool. In certain embodiments, the individual has, or is at risk of having reduced appetite. In certain embodiments, the individual has, or is at risk of having unintended weight loss. In certain embodiments, the individual has, or is at risk of having intestinal inflammation. In certain embodiments, the individual has, or is at risk of having disruption of the epithelial barrier in the gastrointestinal tract. In certain embodiments, the individual has, or is at risk of having dysbiosis. In certain embodiments, the individual has, or is at risk of having increased bowel frequency. In certain embodiments, the individual has, or is at risk of having tenesmus or painful spasms of the anal sphincter. In certain embodiments, the individual has, or is at risk of having constipation. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound reduces or prevents inflammation in the gastrointestinal tract. In certain embodiments, administering the compound reduces or prevents diarrhea. In certain embodiments, administering the compound reduces or prevents pain. In certain embodiments, administering the compound reduces or prevents fatigue. In certain embodiments, administering the compound reduces or prevents abdominal cramping. In certain embodiments, administering the compound reduces or prevents blood in the stool. In certain embodiments, administering the compound improves, preserves, or prevents loss of appetite. In certain embodiments, administering the compound reduces or prevents unintended weight loss. In certain embodiments, administering the compound reduces or prevents fever. In certain embodiments, administering the compound reduces or prevents intestinal inflammation. In certain embodiments, administering the compound reduces or prevents disruption of the epithelial barrier of the gastrointestinal tract. In certain embodiments, administering the compound reduces or prevents dysbiosis. In certain embodiments, administering the compound reduces or prevents increased bowel frequency. In certain embodiments, administering the compound reduces or prevents tenesmus or painful spasms of the anal sphincter. In certain embodiments, administering the compound reduces or prevents constipation. In certain embodiments, the individual is identified as having or at risk of having a disease associated with SMAD7.

In certain embodiments, a method of inhibiting expression of SMAD7 in a cell comprises contacting the cell with a compound comprising a SMAD7 specific inhibitor, thereby inhibiting expression of SMAD7 in the cell. In certain embodiments, the cell is in the gastrointestinal tissue. In certain embodiments, the cell is in the rectum. In certain embodiments, the cell is in the ileum. In certain embodiments, the cell is in the colon. In certain embodiments, the cell is in the sigmoid colon. In certain embodiments, the cell is in the descending colon. In certain embodiments, the cell is in the gastrointestinal tissue of an individual who has, or is at risk of having inflammatory bowel disease. In certain embodiments, the inflammatory bowel disease is ulcerative colitis. In certain embodiments, the inflammatory bowel disease is Crohn's disease. In certain embodiments, the individual has indeterminate colitis. In certain embodiments, the individual has familial adenomatous polyposis. In certain embodiments, the individual has intestinal GvHD. In certain embodiments, the individual has cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound.

In certain embodiments, a method of reducing or inhibiting inflammation in the gastrointestinal tissue, reducing or inhibiting diarrhea, reducing or inhibiting pain, reducing or inhibiting fatigue, reducing of inhibiting abdominal cramping, reducing or inhibiting blood in the stool, reducing or inhibiting intestinal inflammation, reducing or inhibiting disruption of the epithelial barrier of the gastrointestinal tract, reducing or inhibiting dysbiosis, reducing or inhibiting increased bowel frequency, reducing or inhibiting tenesmus or painful spasms of the anal sphincter, reducing or inhibiting constipation, or reducing or inhibiting unintended weight loss in an individual having, or at risk of having, a disease associated with SMAD7 comprises administering to the individual a compound comprising a SMAD7 specific inhibitor. In certain embodiments, the individual has, or is at risk of having diarrhea. In certain embodiments, the individual has, or is at risk of having pain and fatigue. In certain embodiments, the individual has, or is at risk of having abdominal cramping. In certain embodiments, the individual has, or is at risk of having blood in the stool. In certain embodiments, the individual has, or is at risk of having reduced appetite. In certain embodiments, the individual has, or is at risk of having unintended weight loss. In certain embodiments, the individual has, or is at risk of having intestinal inflammation. In certain embodiments, the individual has, or is at risk of having disruption of the epithelial barrier of the gastrointestinal tract. In certain embodiments, the individual has, or is at risk of having dysbiosis. In certain embodiments, the individual has, or is at risk of having increased bowel frequency. In certain embodiments, the individual has, or is at risk of having tenesmus or painful spasms of the anal sphincter. In certain embodiments, the individual has, or is at risk of having constipation. In certain embodiments, the individual has, or is at risk of having, inflammatory bowel disease. In certain embodiments, the inflammatory bowel disease is ulcerative colitis. In certain embodiments, the inflammatory bowel disease is Crohn's disease. In certain embodiments, the individual has, or is at risk of having, indeterminate colitis. In certain embodiments, the individual has, or is at risk of having, familial adenomatous polyposis. In certain embodiments, the individual has, or is at risk of having, intestinal GvHD. In certain embodiments, the individual has, or is at risk of having, cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a disease associated with SMAD7.

Certain embodiments are drawn to a compound comprising a SMAD7 specific inhibitor for use in treating a disease associated with SMAD7. In certain embodiments, the disease is inflammatory bowel disease. In certain embodiments, the disease is ulcerative colitis. In certain embodiments, the disease is Crohn's disease. In certain embodiments, the disease is indeterminate colitis. In certain embodiments, the disease is familial adenomatous polyposis. In certain embodiments, the disease is intestinal GvHD. In certain embodiments, the disease is cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound.

Certain embodiments are drawn to a compound comprising a SMAD7 specific inhibitor for use in reducing or inhibiting inflammation in the gastrointestinal tract, reducing or inhibiting diarrhea, reducing or inhibiting pain, reducing or inhibiting fatigue, reducing of inhibiting abdominal cramping, reducing or inhibiting blood in the stool, reducing or inhibiting intestinal inflammation, reducing or inhibiting disruption of the epithelial barrier of the gastrointestinal tract, reducing or inhibiting dysbiosis, reducing or inhibiting increased bowel frequency, reducing or inhibiting tenesmus or painful spasms of the anal sphincter, reducing or inhibiting constipation, or reducing or inhibiting unintended weight loss in an individual having or at risk of having inflammatory bowel disease. In certain embodiments, the inflammatory bowel disease is ulcerative colitis. the inflammatory bowel disease is Crohn's disease. In certain embodiments, the individual has indeterminate colitis. In certain embodiments, the individual has familial adenomatous polyposis. In certain embodiments, the individual has intestinal GvHD. In certain embodiments, the individual has cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound.

Certain embodiments are drawn to use of a compound comprising a SMAD7 specific inhibitor for the manufacture or preparation of a medicament for treating a disease associated with SMAD7. Certain embodiments are drawn to use of a compound comprising a SMAD7 specific inhibitor for the preparation of a medicament for treating a disease associated with SMAD7. In certain embodiments, the disease is a gastrointestinal disease. In certain embodiments, the individual has, or is at risk of having, inflammatory bowel disease. In certain embodiments, the inflammatory bowel disease is ulcerative colitis. In certain embodiments, the inflammatory bowel disease is Crohn's disease. In certain embodiments, the individual has indeterminate colitis. In certain embodiments, the individual has familial adenomatous polyposis. In certain embodiments, the individual has intestinal GvHD. In certain embodiments, the individual has cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound.

Certain embodiments are drawn to use of a compound comprising a SMAD7 specific inhibitor for the manufacture or preparation of a medicament for reducing or inhibiting inflammation in the gastrointestinal tract, reducing or inhibiting diarrhea, reducing or inhibiting pain, reducing or inhibiting fatigue, reducing or inhibiting abdominal cramping, reducing or inhibiting blood in the stool, reducing or inhibiting intestinal inflammation, reducing or inhibiting disruption of the epithelial barrier of the gastrointestinal tract, reducing or inhibiting dysbiosis, reducing or inhibiting increased bowel frequency, reducing or inhibiting tenesmus or painful spasms of the anal sphincter, reducing or inhibiting constipation, or reducing or inhibiting unintended weight loss in an individual having or at risk of having a gastrointestinal disease associated with SMAD7. In certain embodiments, the gastrointestinal disease is inflammatory bowel disease, ulcerative colitis, Crohn's disease. In certain embodiments, the gastrointestinal disease is indeterminate colitis. In certain embodiments, the gastrointestinal disease is familial adenomatous polyposis. In certain embodiments, the gastrointestinal disease is intestinal GvHD. In certain embodiments, the gastrointestinal disease is cancer therapy-induced colitis. Certain embodiments are drawn to use of a compound comprising a SMAD7 specific inhibitor for the preparation of a medicament for reducing or inhibiting inflammation in the gastrointestinal tract in an individual having or at risk of having inflammatory bowel disease. In certain embodiments, the inflammatory bowel disease is ulcerative colitis or Crohn's disease. In certain embodiments, the individual has indeterminate colitis. In certain embodiments, the individual has familial adenomatous polyposis. In certain embodiments, the individual has intestinal GvHD. In certain embodiments, the individual has cancer therapy-induced colitis. In certain embodiments, the compound comprises an antisense compound targeted to SMAD7. In certain embodiments, the compound comprises an oligonucleotide targeted to SMAD7. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 14-2735. In certain embodiments, the compound comprises a modified oligonucleotide 12 to 80 linked nucleosides in length and having a nucleobase sequence comprising the nucleobase sequence of any one of SEQ ID NOs: 14-2735. In certain embodiments, the compound comprises a modified oligonucleotide consisting of the nucleobase sequence of any one of SEQ ID NOs: 14-2735. In certain embodiments, the compound comprises a modified oligonucleotide of 12 to 80 linked nucleosides in length having a nucleobase sequence comprising any one of SEQ ID NOs: 1456, 2109, 2506, 2537, 2548, or 2633. In certain embodiments, the compound comprises a modified oligonucleotide having a nucleobase sequence consisting of any one of SEQ ID NOs: 1456, 2109, 2506, 2537, 2548, or 2633. In any of the foregoing embodiments, the modified oligonucleotide can be 10 to 30 linked nucleosides in length. In certain embodiments, the compound is ION 830121, ION 829994, ION 830037, ION 798781, ION 790615, or ION 830025. In any of the foregoing embodiments, the compound can be single-stranded or double-stranded. In any of the foregoing embodiments, the compound can be an antisense compound or oligomeric compound.

In any of the foregoing methods or uses, the compound can be targeted to SMAD7. In certain embodiments, the compound comprises or consists of a modified oligonucleotide, for example a modified oligonucleotide 8 to 80 linked nucleosides in length, 10 to 30 linked nucleosides in length, 12 to 30 linked nucleosides in length, or 20 linked nucleosides in length. In certain embodiments, the modified oligonucleotide is at least 80%, 85%, 90%, 95% or 100% complementary to any of the nucleobase sequences recited in SEQ ID NOs: 1-7. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide is 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides in length. In certain embodiments, the modified oligonucleotide is at least 80%, 85%, 90%, 95% or 100% complementary to any of the nucleobase sequences recited in SEQ ID NOs: 1-7. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound comprises or consists of a modified oligonucleotide 12 to 30 linked nucleosides in length and having a nucleobase sequence comprising any one of SEQ ID NOs: 14-2735, wherein the modified oligonucleotide comprises:

a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

In certain embodiments, a compound comprises or consists of a modified oligonucleotide 12-80 linked nucleobases in length having a nucleobase sequence comprising the sequence recited in any one of SEQ ID NOs: 1456, 2109, 2506, 2537, 2548, or 2633, wherein the modified oligonucleotide comprises a gap segment consisting of ten linked deoxynucleosides;
a 5' wing segment consisting of three linked nucleosides; and
a 3' wing segment consisting of three linked nucleosides;

wherein the gap segment is positioned between the 5' wing segment and the 3' wing segment; wherein each nucleoside of each wing segment comprises a cEt sugar; wherein each internucleoside linkage is a phosphorothioate linkage; and wherein each cytosine is a 5-methylcytosine. In certain embodiments, the modified oligonucleotide is 16-80 linked nucleosides in length. In certain embodiments, the modified oligonucleotide is 10-30 linked nucleosides in length.

In certain embodiments a compound comprises or consists of ION 830025, designated as 2'-O,4'-C—[(S)-ethylidene]-5-methyl-P-thiouridylyl-(3'-O→5'-O)-2'-O,4'-C—[(S)-ethylidene]-5-methyl-Pthiouridylyl-(3'-O→5'-O)-2'-O,4'-C—[(S)-ethylidene]-5-methyl-P-thiouridylyl-(3'-O→5'-O)-2'-deoxy-Pthioguanylyl-(3'-O→5'-O)—P-thiothymidylyl-(3'-O→5'-O)-2'-deoxy-P-thioadenylyl-(3'-O→5'-O)-2'-deoxy-P-thioadenylyl-(3'-O→5'-O)-2'-deoxy-Pthioadenylyl-(3'-O→5'-O)—P-thiothymidylyl-(3'-O→5'-O)-2'-deoxy-5-methyl-P-thiocytidylyl-(3'-O→5'-O)-2'-deoxy-P-thioguanylyl-(3'-O→5'-O)-2'-deoxy-Pthioadenylyl-(3'-O→5'-O)-2'-deoxy-P-thioadenylyl-(3'-O→5'-O)-2'-O,4'-C—[(S)-ethylidene]-Pthioadenylyl-(3'-O→5'-O)-2'-O,4'-C—[(S)-ethylidene]-P-thioguanylyl-(3'-O→5'-O)-2'-O,4'-C—[(S)-ethylidene]-5-methylcytidine, sodium salt In certain embodiments, a compound comprises or consists of ION 830025 or salt thereof, having the following chemical structure:

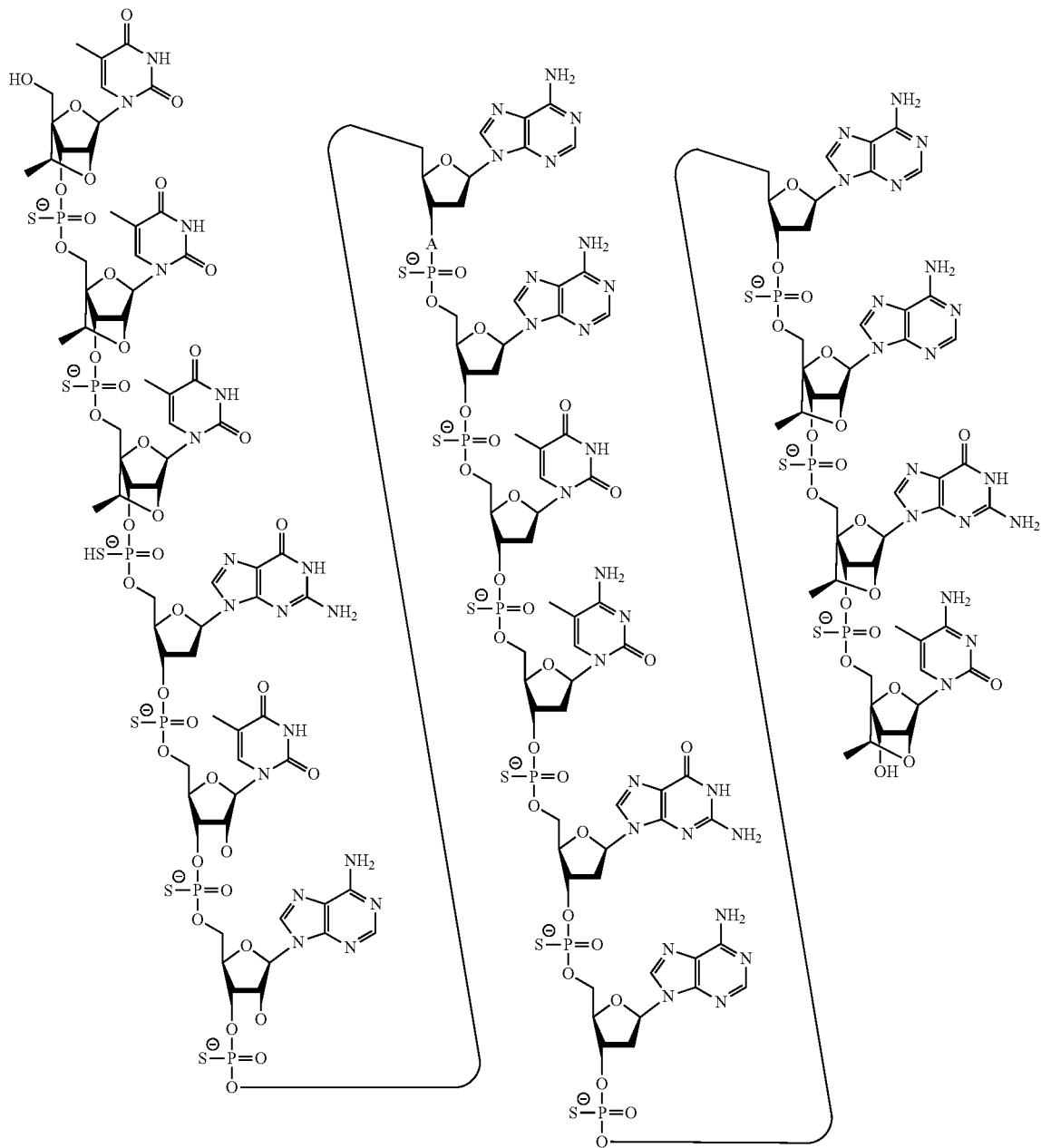

In certain embodiments, a compound comprises or consists of the sodium salt of ION 830025, having the following chemical structure:
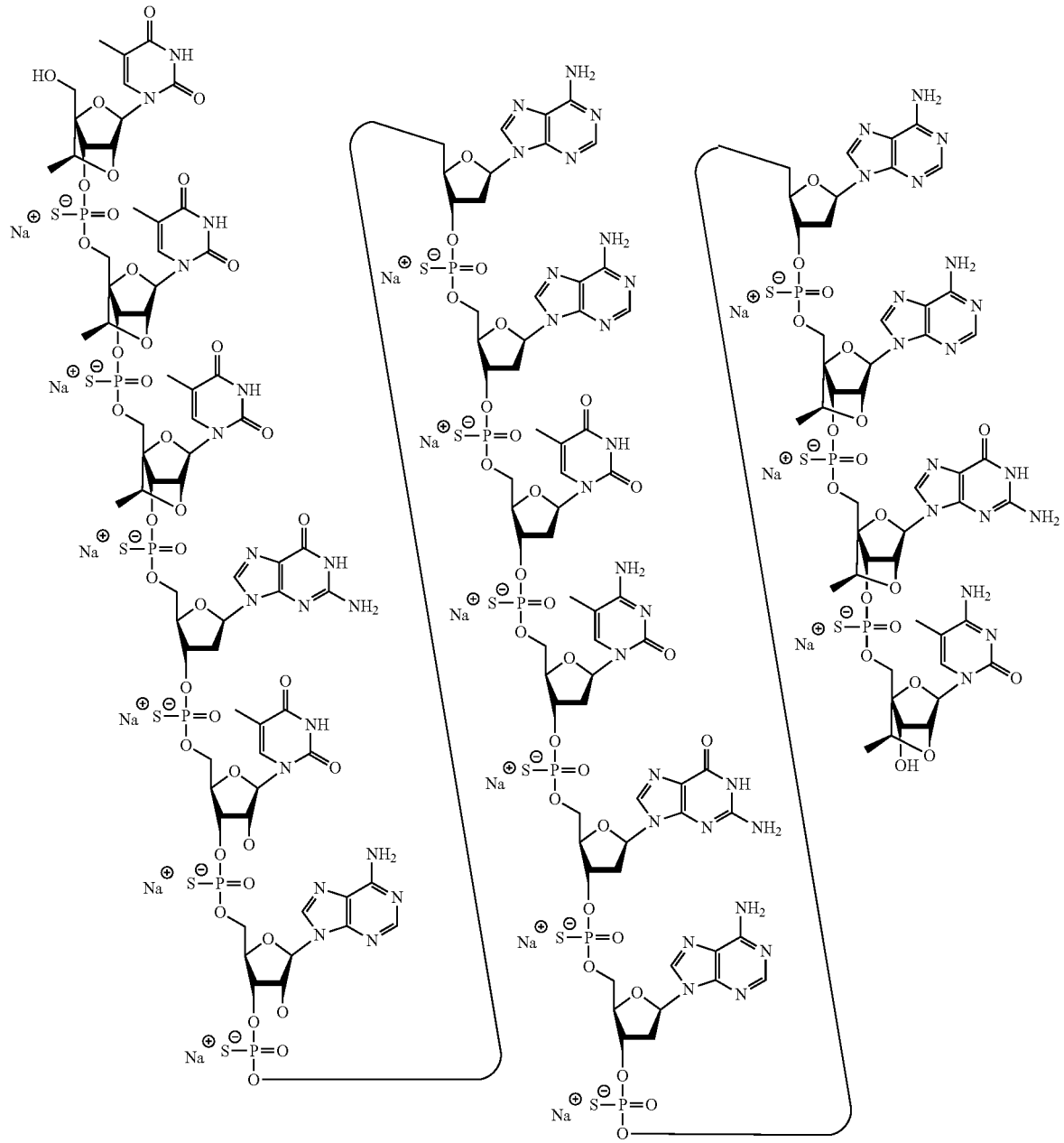

In certain embodiments, a compound comprises or consists of ION 798781 or salt thereof, having the following chemical structure:
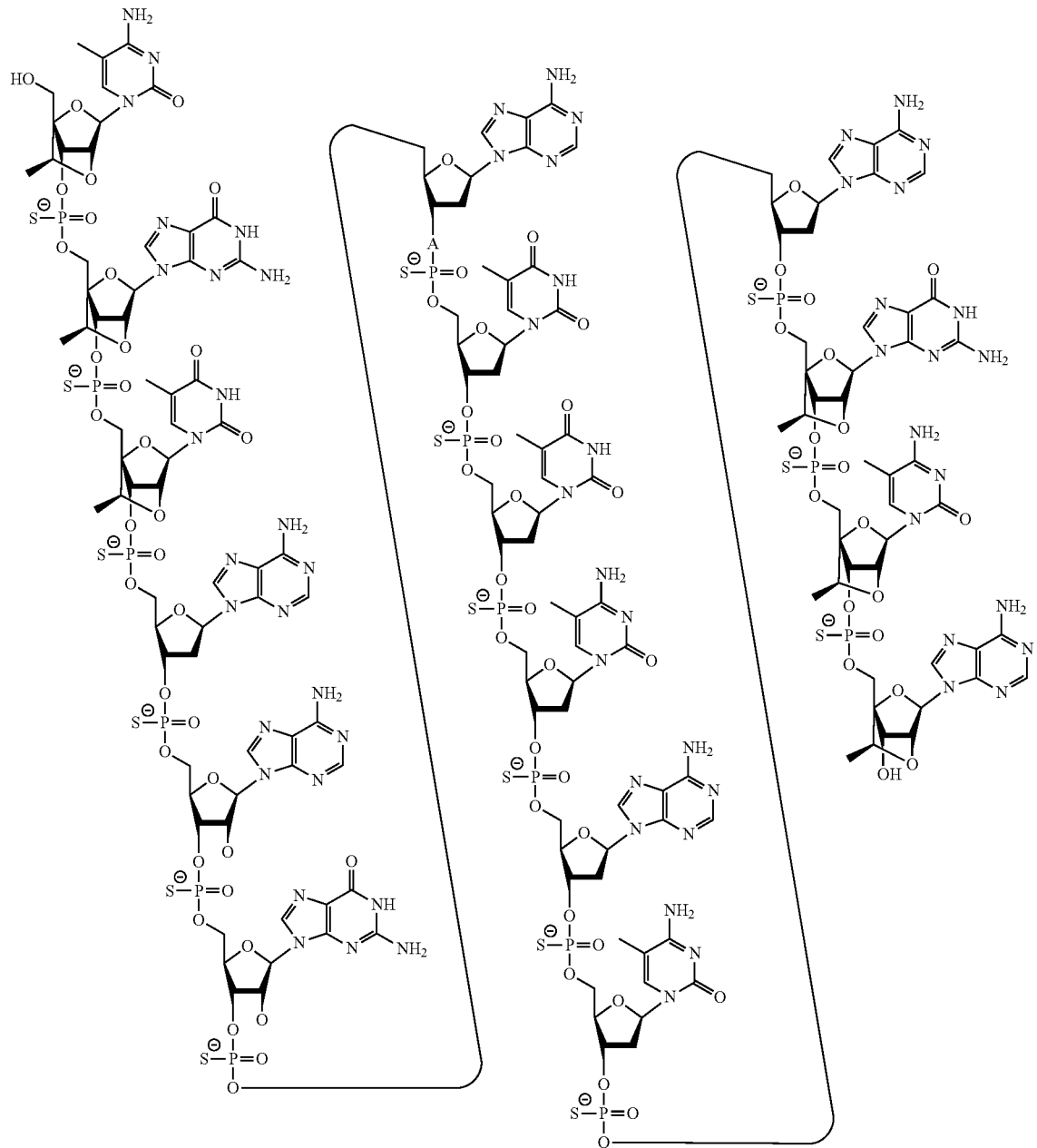

In certain embodiments, a compound comprises or consists of the sodium salt of ION 798781, having the following chemical structure:

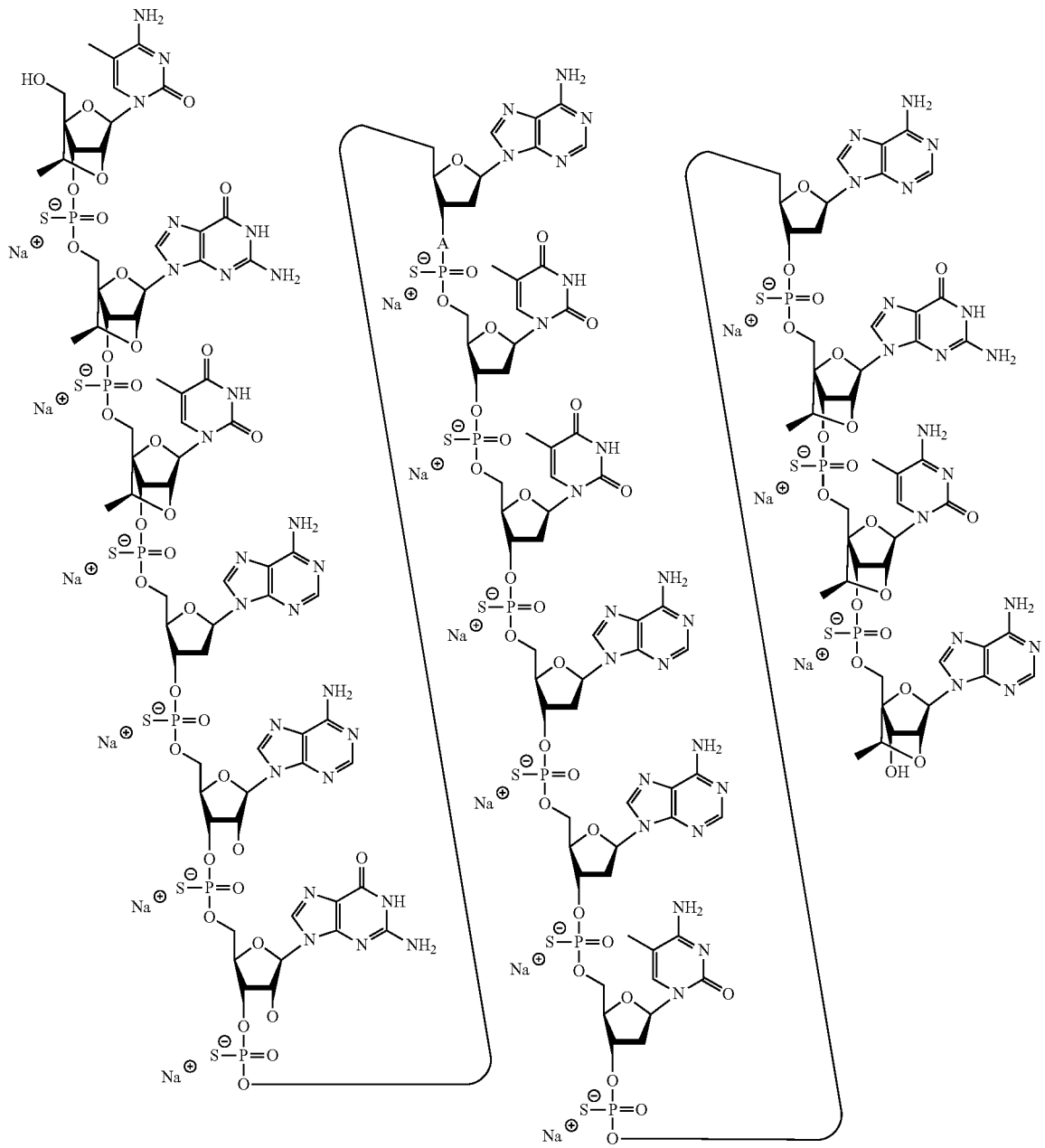

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide is 12-30 linked nucleosides in length and the second modified oligonucleotide is 12-30 linked nucleosides in length. In certain embodiments, one of the modified oligonucleotides has a nucleobase sequence comprising at least 8 contiguous nucleobases of any of SEQ ID NOs: 14-2735.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, a compound described herein comprises an oligonucleotide 12 to 30 linked subunits in length. In certain embodiments, a compound described herein comprises an oligonucleotide 12 to 22 linked subunits in length. In certain embodiments, compound described herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length. In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 21 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits in length, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an SMAD7 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst.* March 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to SMAD7 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 14-2735 and a second strand. In certain embodiments, the compound comprises a first strand comprising the nucleobase sequence of any one of SEQ ID NOs: 14-2735 and a second strand. In certain embodiments, the compound comprises ribonucleotides in which the first strand has uracil (U) in place of thymine (T) in any one of SEQ ID NOs: 14-2735. In certain embodiments, the compound comprises (i) a first strand comprising a nucleobase sequence complementary to the site on SMAD7 to which any of SEQ ID NOs: 14-2735 is targeted, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to SMAD7 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 14-2735. In certain embodiments, the compound comprises the nucleobase sequence of any one of SEQ ID NOs: 14-2735. In certain embodiments, the compound comprises ribonucleotides in which uracil (U) is in place of thymine (T) in any one of SEQ ID NOs: 14-2735. In certain embodiments, the compound comprises a nucleobase sequence complementary to the site on SMAD7 to which any of SEQ ID NOs: 14-2735 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ss-RNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode SMAD7 include, without limitation, the following: RefSeq or GENBANK Accession No. NM 005904.3 (incorporated by reference, disclosed herein as SEQ ID NO: 1), complement of NT_010966.15 truncated from nucleotides 28007000 to 28041000 (incorporated by reference, disclosed herein as SEQ ID NO: 2), NM_001190823.1 (incorporated by reference, disclosed herein as SEQ ID NO: 3), NM_001190822.1 (incorporated by reference, disclosed herein as SEQ ID NO: 4), NM_001190821.1 (incorporated by reference, disclosed herein as SEQ ID NO: 5), AF015261.1 (incorporated by reference, disclosed herein as SEQ ID NO: 6), and AF010193.1 (incorporated by reference, disclosed herein as SEQ ID NO: 7).

Hybridization

In some embodiments, hybridization occurs between a compound disclosed herein and a SMAD7 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a SMAD7 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a SMAD7 nucleic acid may be tolerated provided that the compound remains able to specifically hybridize to a target nucleic acid. Moreover, a compound may hybridize over one or more segments of a SMAD7 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a SMAD7 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a SMAD7 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.,* 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a SMAD7 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a SMAD7 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a SMAD7 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the—compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of an compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified furanosyl sugar moieties comprising one or more acyclic substituent, including but not limited to substituents at the 2', 4', and/or 5' positions. In certain embodiments, the furanosyl sugar moiety is a ribosyl sugar moiety. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearly non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O- 2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem.,2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U S. A., 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 20017, 129, 8362-8379; Elayadi et al., Curr. Opinion Invens. Drugs, 2001, 2, 558-561; Braasch et al., Chem. Biol., 2001, 8, 1-7; Orum et al., Curr. Opinion Mol. Ther., 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al. U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

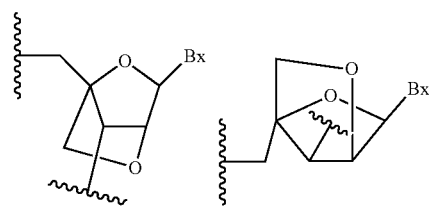

LNA (β-D-configuration) α-L-LNA (α-L-configuration)

bridge=4'-CH$_2$—O-2' bridge=4'-CH$_2$—O-2'

α-L-methyleneoxy (4'-CH$_2$—O-2') or α-L-LNA bicyclic nucleosides have been incorporated into oligonucleotides that showed antisense activity (Frieden et al., Nucleic Acids Research, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. Bioorg. & Med. Chem. 2002, 10, 841-854), fluoro HNA:

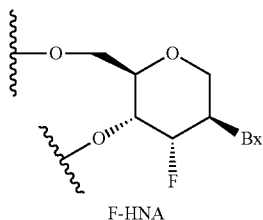

F-HNA ("F—HNA", see e.g., Swayze et al., U.S. Pat. No. 8,088,904; Swayze et al., U.S. Pat. No. 8,440,803; Swayze et al., U.S.; and Swayze et al., U.S. Pat. No. 9,005,906, F—HNA can also be referred to as a F-THP or 3'-fluoro tetrahydropyran), and nucleosides comprising additional modified THP compounds having the formula:

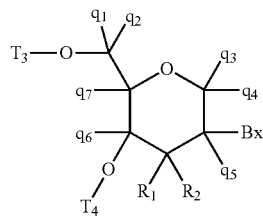

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

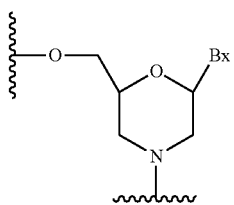

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH3) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp).

Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

In certain embodiments, compounds targeted to a SMAD7 nucleic acid comprise one or more modified nucleobases. In certain embodiments, the modified nucleobase is 5-methylcytosine. In certain embodiments, each cytosine is a 5-methylcytosine.

3. Modified Internucleoside Linkages

The naturally occurring internucleoside linkage of RNA and DNA is a 3' to 5' phosphodiester linkage In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

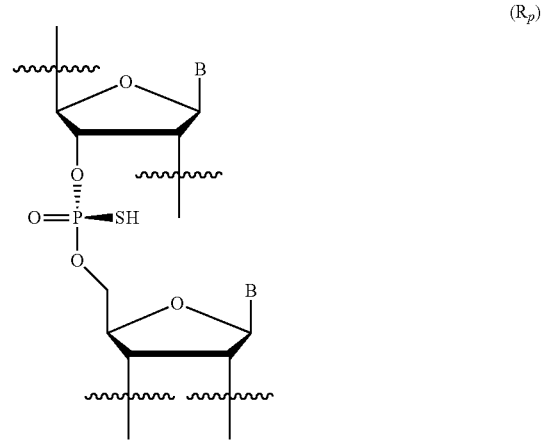

(R$_p$)

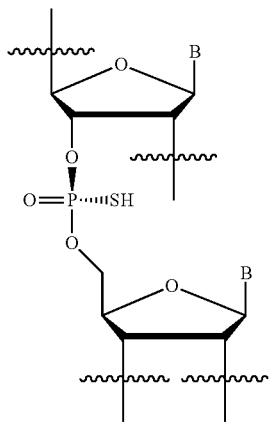
(S$_p$)

Unless otherwise indicated, chiral internucleoside linkages of modified oligonucleotides described herein can be stereorandom or in a particular stereochemical configuration.

In certain embodiments, compounds targeted to a SMAD7 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P═O") (also referred to as unmodified or naturally occurring linkages), phosphotriesters, methylphosphonates, phosphoramidates, and phosphorothioates ("P═S"), and phosphorodithioates ("HS—P═S"). Representative non-phosphorus containing internucleoside linking groups include but are not limited to methylenemethylimino (—CH2-N(CH3)-O—CH2-), thiodiester, thionocarbamate (—O—C(═O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(═O)—N(H)-5'), amide-4 (3'-CH2-N(H)—C(═O)-5'), formacetal (3'-O—CH2-O-5'), methoxypropyl, and thioformacetal (3'-S—CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosphonate linkages. In certain embodiments, one methylphosphonate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

4. Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

5. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., Ann. N.Y. Acad. Sci., 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic, a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 923-937), a tocopherol group (Nishina et al., *Molecular Therapy Nucleic Acids*, 2015, 4, e220; doi:10.1038/mtna.2014.72 and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indo-methicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to SMAD7 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to SMAD7 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

EXAMPLES

The Examples below describe the screening process to identify lead compounds targeted to human SMAD7. Out of over 2,720 oligonucleotides that were screened, ION 830025, ION 798781, and ION 790615 emerged as the top lead compounds. In particular, ION 830025 exhibited the best combination of properties in terms of potency and tolerability.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

Certain compounds described herein (e.g. modified oligonucleotides) have one or more asymmetric centers and thus give rise to enantiomers, diastereomers, and other stereoisomeric configurations that may be defined, in terms of absolute stereochemistry, as (R) or (S), as α or β, such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms. Likewise, all tautomeric forms of the compounds provided herein are included unless otherwise indicated. Unless otherwise indicated, oligomeric compounds and modified oligonucleotides described herein are intended to include corresponding salt forms.

Compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human SMAD7 mRNA Expression in Hep3B Cells by 5-10-5 MOE Gapmers Antisense oligonucleotides were designed to target human SMAD7 mRNA and were tested for their effects on SMAD7 mRNA expression in vitro. Cultured Hep3B cells at a density of 20,000 cells per well were transfected using electroporation with antisense oligonucleotide ION 483663 (a 5-10-5 MOE gapmer), the sequence of which overlaps with ION 28453 (a 4-10-4 MOE gapmer) was included in these assays for comparison. ION 28453 has been previously disclosed in U.S. Pat. No. 6,159,697). After a treatment period of approximately 24 hours, RNA was isolated from the cells and SMAD7 mRNA levels were measured by quantitative real-time PCR. Primer probe set RTS5062 (forward sequence TTTCTCAAACCAACTGCAGACTGT, designated herein as SEQ ID NO: 11; reverse sequence CAGATAATTCGTTCCCCCTGTT, designated herein as SEQ ID NO: 12; probe sequence CAGATGCTGTGCCTTCCTCCGCTG, designated herein as SEQ ID NO: 13) was used to measure human SMAD7 mRNA levels. SMAD7 mRNA levels were adjusted according to total RNA content, as measured by RIBOGREEN®. Results are presented as percent inhibition of SMAD7 mRNA expression, relative to untreated control cells.

The newly designed chimeric antisense oligonucleotides in the Tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P═S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human SMAD7 mRNA, designated herein as SEQ ID NO: 1 (GENBANK Accession No. NM_005904.3) or the human SMAD7 genomic sequence, designated herein as SEQ ID NO: 2 (complement of GENBANK Accession No. NT_010966.15 truncated from nucleotides 28007000 to 28041000). 'n/a' indicates that the antisense oligonucleotide does not target that particular gene sequence with 100% complementarity.

Study 1

Cultured Hep3B cells at a density of 20,000 cells per well were transfected using electroporation with 5,000 nM antisense oligonucleotide.

TABLE 1

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771390 | 25 | 44 | CGGCTGCCCCACCCCGCGCG | 32 | 1520 | 1539 | 14 |
| 771398 | 137 | 156 | GGCAGGAGCGGCGGCGGCCC | 53 | 1632 | 1651 | 15 |
| 483665 | 224 | 243 | GCGAACATGACCTCCGCACA | 10 | 1719 | 1738 | 16 |
| 771412 | 395 | 414 | TCGCCCCTTCTCCCCGCAGC | 52 | 1890 | 1909 | 17 |
| 771420 | 436 | 455 | GCCCGGGCCGCCGCCACCGG | 1 | 1931 | 1950 | 18 |
| 771428 | 476 | 495 | TGGCACCTCGCACCGCCTTG | 0 | 1971 | 1990 | 19 |
| 771436 | 604 | 623 | GAGCAGCAGCTCCAGCTGCC | 50 | 2099 | 2118 | 20 |
| 771444 | 798 | 817 | AGCCTCTTGACTTCCGAGGA | 65 | 2293 | 2312 | 21 |
| 483663 | 799 | 818 | CAGCCTCTTGACTTCCGAGG | 47 | 2294 | 2313 | 22 |
| 771350 | N/A | N/A | TTTGCCCCAAAACTCCAAAG | 68 | 2933 | 2952 | 23 |
| 771707 | N/A | N/A | TTGTTCCTCTGCACCCTGGG | 0 | 3007 | 3026 | 24 |
| 771452 | 911 | 930 | GGTATCTGGAGTAAGGAGGG | 25 | 3780 | 3799 | 25 |
| 771715 | N/A | N/A | AGTCTCCGAGTTATCCCCAT | 68 | 4142 | 4161 | 26 |
| 771723 | N/A | N/A | CCAAGGTTACATACAACCTG | 0 | 4657 | 4676 | 27 |
| 771731 | N/A | N/A | AAAACTTTGTGCCTGTTTCA | 44 | 5978 | 5997 | 28 |
| 771739 | N/A | N/A | TTTGAAAACCCAACCCTGGG | 22 | 7243 | 7262 | 29 |
| 771747 | N/A | N/A | GTGTGTTTCAAAGGAAAAGC | 2 | 7881 | 7900 | 30 |
| 771755 | N/A | N/A | AAACATTTGGCACCCAACAC | 44 | 8898 | 8917 | 31 |
| 771358 | N/A | N/A | AGTTAATCATTACTCGAGTC | 53 | 9415 | 9434 | 32 |
| 771366 | N/A | N/A | TGCTGATTATTAATGGTCTG | 49 | 9503 | 9522 | 33 |
| 771374 | N/A | N/A | AGCATGAAAGACAAACCACA | 44 | 9552 | 9571 | 34 |
| 771382 | N/A | N/A | AAATAAAAACACCAAGATCC | 55 | 9593 | 9612 | 35 |
| 771763 | N/A | N/A | CCCCGTCCACGGAACGGATC | 34 | 9930 | 9949 | 36 |
| 771771 | N/A | N/A | CAGCTCCTACTGTTGGCAGT | 63 | 10275 | 10294 | 37 |
| 771779 | N/A | N/A | ACACACTGCTGCCTTTCTC | 53 | 11011 | 11030 | 38 |
| 771787 | N/A | N/A | AAGAAGAAGGAGCTCAAACT | 0 | 11997 | 12016 | 39 |
| 771795 | N/A | N/A | CGTCTGCGGCAAAACCCACC | 53 | 13057 | 13076 | 40 |
| 771803 | N/A | N/A | ATGGATACTGACTCAAGGAC | 22 | 13937 | 13956 | 41 |
| 771811 | N/A | N/A | TGCCTCATTCTTTCCAGGAC | 48 | 14665 | 14684 | 42 |
| 771819 | N/A | N/A | AATAGTTTTCTCTCAAATGT | 56 | 15647 | 15666 | 43 |
| 771827 | N/A | N/A | AAGGACATCACAGGGACTGG | 31 | 16679 | 16698 | 44 |
| 771835 | N/A | N/A | AGTAAAATGGGAAATAAGGC | 17 | 17567 | 17586 | 45 |
| 771843 | N/A | N/A | CGCCGGCCCACCAACCTCTG | 19 | 18438 | 18457 | 46 |
| 771851 | N/A | N/A | GCTTTGAAAACATCCCACTT | 25 | 19314 | 19333 | 47 |
| 771859 | N/A | N/A | CCAGAAAATGCAGACAGCTA | 43 | 19898 | 19917 | 48 |
| 771867 | N/A | N/A | ACTGGGCTTCAGCAAAGATA | 39 | 20754 | 20773 | 49 |

TABLE 1-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771875 | N/A | N/A | CCCCGTGCACTCCCAGCCCT | 42 | 22089 | 22108 | 50 |
| 771883 | N/A | N/A | AGCTGGCACTGAATGCTGAT | 0 | 22695 | 22714 | 51 |
| 771891 | N/A | N/A | CTCCCAAGCCTACATATTTC | 65 | 23560 | 23579 | 52 |
| 771899 | N/A | N/A | CCTGATTGTCTCCACATCCC | 57 | 24447 | 24466 | 53 |
| 771691 | N/A | N/A | CCAGGAGGGTATGCACACTC | 17 | 2494 2516 2538 | 2513 2535 2557 | 54 |
| 771699 | N/A | N/A | TGCACACTCTCCCAGGAGGG | 49 | 2505 2527 | 2524 2546 | 55 |
| 771907 | N/A | N/A | TCTATTCTCACGCCAAACCA | 42 | 25268 | 25287 | 56 |
| 771915 | N/A | N/A | CTGGGCCCAGACACACAAAG | 10 | 25941 | 25960 | 57 |
| 771923 | N/A | N/A | CCCCAGAAAACTGTACAGGG | 29 | 26950 | 26969 | 58 |
| 771931 | N/A | N/A | CCCAGCCCAGAAAAACTGCA | 22 | 27602 | 27621 | 59 |
| 771939 | N/A | N/A | TTCCCTACAGACACCCCAAG | 45 | 28589 | 28608 | 60 |
| 771947 | N/A | N/A | TTAACCCGGGCTACCTTAAC | 61 | 29533 | 29552 | 61 |
| 771460 | 1081 | 1100 | CGTCTTCTCCTCCCAGTATG | 54 | 30348 | 30367 | 62 |
| 771468 | 1198 | 1217 | CACCAGCTGACTCTTGTTGT | 21 | 30465 | 30484 | 63 |
| 771476 | 1258 | 1277 | CACACCATCCACCTCCCGCG | 19 | 30525 | 30544 | 64 |
| 771484 | 1441 | 1460 | CGTCCACGGCTGCTGCATAA | 51 | 30708 | 30727 | 65 |
| 771492 | 1510 | 1529 | GCTGCTGATGAACTGGCGGG | 53 | 30777 | 30796 | 66 |
| 771500 | 1555 | 1574 | ACGCGGCTACCGGCTGTTGA | 38 | 30822 | 30841 | 67 |
| 771507 | 1584 | 1603 | CTGCTCAGCTCACGCTCTGT | 24 | 30851 | 30870 | 68 |
| 771515 | 1617 | 1636 | AAATATTAGCAGCAAAGTAG | 13 | 30884 | 30903 | 69 |
| 771523 | 1644 | 1663 | TGCATGAAAAGCAAGCACTC | 47 | 30911 | 30930 | 70 |
| 771531 | 1665 | 1684 | AAAAAAAACGACCAAAGAGT | 40 | 30932 | 30951 | 71 |
| 771539 | 1738 | 1757 | AGCTATTTCTCAAAGAGCGA | 24 | 31005 | 31024 | 72 |
| 771547 | 1798 | 1817 | GTGTCCTGCCGATCATACCT | 45 | 31065 | 31084 | 73 |
| 771555 | 1841 | 1860 | GTTTGGTGGTGCTTGGATTT | 0 | 31108 | 31127 | 74 |
| 771563 | 1893 | 1912 | TCACACACACTCCTGACAAG | 32 | 31160 | 31179 | 75 |
| 771571 | 2009 | 2028 | TTGGGACTGCAAACCTCTCT | 71 | 31276 | 31295 | 76 |
| 771579 | 2061 | 2080 | AGGTACTGCCTCTGCCCCAC | 58 | 31328 | 31347 | 77 |
| 771587 | 2160 | 2179 | CGTGTCCTTGATGAGGGAGA | 6 | 31427 | 31446 | 78 |
| 771595 | 2217 | 2236 | AATTGGTTCTGGTTCGGCCA | 36 | 31484 | 31503 | 79 |
| 771603 | 2306 | 2325 | CTCAGGGAGATCCAGGAGCA | 34 | 31573 | 31592 | 80 |
| 771611 | 2412 | 2431 | GAAAACCTGATGTCACCAG | 70 | 31679 | 31698 | 81 |
| 771619 | 2457 | 2476 | CACAGGATGGGAGCAGGCAG | 37 | 31724 | 31743 | 82 |
| 771627 | 2485 | 2504 | CTTGCTGGCCTAATAGCAGA | 0 | 31752 | 31771 | 83 |
| 771635 | 2556 | 2575 | GGTTATGACGGACCAAATCC | 48 | 31823 | 31842 | 84 |

TABLE 1-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771643 | 2596 | 2615 | ATGAAAGAAGAGTTAGGTGT | 2 | 31863 | 31882 | 85 |
| 771651 | 2645 | 2664 | GCTAAGAACAGTGTCGAAGT | 37 | 31912 | 31931 | 86 |
| 771659 | 2685 | 2704 | AGAAAAATAGCTTATGTTAA | 32 | 31952 | 31971 | 87 |
| 771667 | 2749 | 2768 | AAAGCACTACAATGCTAAAT | 44 | 32016 | 32035 | 88 |
| 771675 | 2793 | 2812 | CTTTAATAAATCTCAGGTTT | 44 | 32060 | 32079 | 89 |
| 771683 | 2950 | 2969 | GCATTTGTTATTTGCATTTA | 0 | 32217 | 32236 | 90 |

Study 2

Cultured Hep3B cells at a density of 20,000 cells per well were transfected using electroporation with 15,000 nM antisense oligonucleotide. The antisense oligonucleotides were tested in a series of experiments that had similar culture conditions as described below. The results for each experiment are presented in separate tables shown below.

Some of the oligonucleotides presented were complementary to SMAD7 mRNA sequences RefSeqNo. NM_001190821.1 (designated herein as SEQ ID NO: 3) or RefSeqNo. NM_001190822.1 (designated herein as SEQ ID NO: 4), and are presented in a separate table shown below.

TABLE 2

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771392 | 28 | 47 | CTCCGGCTGCCCCACCCCGC | 28 | 1523 | 1542 | 91 |
| 771400 | 162 | 181 | CGACAGCAGCAGCAGCAGGG | 52 | 1657 | 1676 | 92 |
| 771406 | 226 | 245 | GAGCGAACATGACCTCCGCA | 55 | 1721 | 1740 | 93 |
| 771414 | 406 | 425 | TCGGCTGTCCGTCGCCCCTT | 65 | 1901 | 1920 | 94 |
| 771422 | 446 | 465 | ATCCAGCCCTGCCCGGGCCG | 27 | 1941 | 1960 | 95 |
| 771430 | 512 | 531 | CGCCCGCGGCTGGCGGGTGG | 40 | 2007 | 2026 | 96 |
| 771438 | 614 | 633 | CCACGGCCTGGAGCAGCAGC | 26 | 2109 | 2128 | 97 |
| 483663 | 799 | 818 | CAGCCTCTTGACTTCCGAGG | 49 | 2294 | 2313 | 22 |
| 771446 | 801 | 820 | CACAGCCTCTTGACTTCCGA | 55 | 2296 | 2315 | 98 |
| 771352 | N/A | N/A | TCCAACTCTCTTTGCCCCAA | 54 | 2943 | 2962 | 99 |
| 771709 | N/A | N/A | TGAACCCTCACATCACACTC | 38 | 3233 | 3252 | 100 |
| 771717 | N/A | N/A | TCCCATCTATCGAATCACCC | 57 | 4199 | 4218 | 101 |
| 771725 | N/A | N/A | CTTGAGGGAGCTGGTAGAGT | 8 | 4937 | 4956 | 102 |
| 771733 | N/A | N/A | TGACAGCCACAAGTCACAAC | 75 | 6282 | 6301 | 103 |
| 771741 | N/A | N/A | GGTCTCACCTTAGGCCTGTG | 53 | 7417 | 7436 | 104 |
| 771749 | N/A | N/A | GAAATGGAGTTACTTGTTAA | 29 | 8081 | 8100 | 105 |
| 771757 | N/A | N/A | TCCCCTTTTTTAATTGAGGA | 48 | 9147 | 9166 | 106 |
| 771360 | N/A | N/A | ACCTTGTCACCCGTCTGGGC | 49 | 9446 | 9465 | 107 |
| 771368 | N/A | N/A | CGGCCTTGATGCTGATTATT | 27 | 9512 | 9531 | 108 |

TABLE 2-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771376 | N/A | N/A | ACGCTCTAAACAGCATGAAA | 17 | 9563 | 9582 | 109 |
| 771384 | N/A | N/A | TGCTGTGGATTTGAAAAGGG | 18 | 9634 | 9653 | 110 |
| 771765 | N/A | N/A | CCAAGCCAGGAGCTGCTTAA | 48 | 10004 | 10023 | 111 |
| 771773 | N/A | N/A | TCTTTTCGCATCCTCAGGAA | 57 | 10417 | 10436 | 112 |
| 771781 | N/A | N/A | AAAAAAAGCCCACCCATCGG | 10 | 11737 | 11756 | 113 |
| 771789 | N/A | N/A | CCCAAAACAGTGTACCCTCC | 30 | 12061 | 12080 | 114 |
| 771797 | N/A | N/A | GCACAGACTGCCAAATCACA | 62 | 13240 | 13259 | 115 |
| 771805 | N/A | N/A | GATTATATAGGTATTTTGA | 0 | 14032 | 14051 | 116 |
| 771813 | N/A | N/A | TCTTGTCTGGCCGGCAGAGC | 38 | 14745 | 14764 | 117 |
| 771821 | N/A | N/A | GTTCCTTATAGATTATCCAA | 60 | 15906 | 15925 | 118 |
| 771829 | N/A | N/A | TGTGCCTCAGCAGTTAATAA | 14 | 16914 | 16933 | 119 |
| 771837 | N/A | N/A | AGTGTTGAGGACTCCCCAGC | 48 | 17670 | 17689 | 120 |
| 771845 | N/A | N/A | TTCCAAGCACGGAGTCAGCC | 39 | 18578 | 18597 | 121 |
| 771853 | N/A | N/A | AGCTTGGAAGCCATCGGTTG | 36 | 19576 | 19595 | 122 |
| 771861 | N/A | N/A | AGAAAACAGCCCCCCCAGCA | 13 | 20217 | 20236 | 123 |
| 771869 | N/A | N/A | AGCCAAGTGTCCATCAAGCA | 62 | 21276 | 21295 | 124 |
| 771877 | N/A | N/A | TGCAGGATCCGATGGAAAAG | 24 | 22147 | 22166 | 125 |
| 771885 | N/A | N/A | CAAGTCTCTTACCTCACCCA | 60 | 22783 | 22802 | 126 |
| 771893 | N/A | N/A | GTCATCCGTCCACTGTCTGC | 35 | 23633 | 23652 | 127 |
| 771901 | N/A | N/A | AAAATGCCCACCAGTCTTCC | 41 | 24465 | 24484 | 128 |
| 771693 | N/A | N/A | TCCCAGGAGGGTATGCACAC | 45 | 2496 2518 2540 | 2515 2537 2559 | 129 |
| 771701 | N/A | N/A | GGTATGCACACTCTCCCAGG | 34 | 2509 2531 | 2528 2550 | 130 |
| 771909 | N/A | N/A | CAGGCTCCCTGTGCCAATCA | 52 | 25580 | 25599 | 131 |
| 771917 | N/A | N/A | CCAGACCCCTTCTTAAATTT | 22 | 26148 | 26167 | 132 |
| 771925 | N/A | N/A | GGCCTCTCGCTGATAGTTAA | 10 | 27055 | 27074 | 133 |
| 771933 | N/A | N/A | ATCGAGGTGCCCCCATGCCA | 31 | 27832 | 27851 | 134 |
| 771941 | N/A | N/A | TCAATGATGATGGGTTGCAC | 40 | 28878 | 28897 | 135 |
| 771949 | N/A | N/A | AGATCTTTCAACTGGATGGA | 26 | 29895 | 29914 | 136 |
| 771462 | 1108 | 1127 | CTGGACACAGTAGAGCCTCC | 31 | 30375 | 30394 | 137 |
| 771470 | 1208 | 1227 | GCACCTTCTGCACCAGCTGA | 56 | 30475 | 30494 | 138 |
| 771478 | 1348 | 1367 | CACCTTGTGTACCAACAGCG | 53 | 30615 | 30634 | 139 |
| 771486 | 1451 | 1470 | CGGTAAAGCCCGTCCACGGC | 52 | 30718 | 30737 | 140 |
| 771494 | 1521 | 1540 | CAGCACGGGCAGCTGCTGAT | 20 | 30788 | 30807 | 141 |
| 771502 | 1572 | 1591 | CGCTCTGTCCCCTCCGCACG | 48 | 30839 | 30858 | 142 |

TABLE 2-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771509 | 1587 | 1606 | GGCCTGCTCAGCTCACGCTC | 65 | 30854 | 30873 | 143 |
| 771517 | 1627 | 1646 | CTCAGGAGGAAAATATTAGC | 25 | 30894 | 30913 | 144 |
| 771525 | 1646 | 1665 | TTTGCATGAAAAGCAAGCAC | 28 | 30913 | 30932 | 145 |
| 771533 | 1704 | 1723 | CAAACGAGGACGAGAAGAAG | 2 | 30971 | 30990 | 146 |
| 771541 | 1748 | 1767 | TCTTTTCATAAGCTATTTCT | 35 | 31015 | 31034 | 147 |
| 771549 | 1813 | 1832 | CCTCTTCCTATCAGGGTGTC | 49 | 31080 | 31099 | 148 |
| 771557 | 1866 | 1885 | ATGACCGCCCCCCTTCATAC | 19 | 31133 | 31152 | 149 |
| 771565 | 1938 | 1957 | CTGCCGCTCCTGCACACGCG | 55 | 31205 | 31224 | 150 |
| 771573 | 2011 | 2030 | GCTTGGGACTGCAAACCTCT | 65 | 31278 | 31297 | 151 |
| 771581 | 2085 | 2104 | GGGACCCCAGCCGCCAGCTT | 58 | 31352 | 31371 | 152 |
| 771589 | 2170 | 2189 | TGGACAGGCCCGTGTCCTTG | 51 | 31437 | 31456 | 153 |
| 771597 | 2238 | 2257 | GAATAAGACAAGGATGAAAA | 0 | 31505 | 31524 | 154 |
| 771605 | 2336 | 2355 | GGCTGCCCCGGCAGCCCTTG | 26 | 31603 | 31622 | 155 |
| 771613 | 2422 | 2441 | CTAAGTCCGGGAAAAACCTG | 21 | 31689 | 31708 | 156 |
| 771621 | 2460 | 2479 | ACACACAGGATGGGAGCAGG | 36 | 31727 | 31746 | 157 |
| 771629 | 2512 | 2531 | AGCATGTCCCTCCCAGGGAC | 25 | 31779 | 31798 | 158 |
| 771637 | 2566 | 2585 | TGGTACCTTGGGTTATGACG | 23 | 31833 | 31852 | 159 |
| 771645 | 2608 | 2627 | GTTGTAGAAGAAATGAAAGA | 38 | 31875 | 31894 | 160 |
| 771653 | 2655 | 2674 | TGCTCATTGAGCTAAGAACA | 33 | 31922 | 31941 | 161 |
| 771661 | 2719 | 2738 | AATGCTTCTCTTGTTCATTT | 69 | 31986 | 32005 | 162 |
| 771669 | 2759 | 2778 | TTTCTCTCTCAAAGCACTAC | 55 | 32026 | 32045 | 163 |
| 771677 | 2900 | 2919 | TTTCTTGTTTATACACATTG | 21 | 32167 | 32186 | 164 |
| 771685 | 2963 | 2982 | CTTTTTTAATTTGGCATTTG | 17 | 32230 | 32249 | 165 |

TABLE 3

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771390 | 25 | 44 | CGGCTGCCCCACCCCGCGCG | 66 | 1520 | 1539 | 14 |
| 771391 | 27 | 46 | TCCGGCTGCCCCACCCCGCG | 16 | 1522 | 1541 | 166 |
| 771393 | 29 | 48 | GCTCCGGCTGCCCCACCCCG | 0 | 1524 | 1543 | 167 |
| 771394 | 30 | 49 | CGCTCCGGCTGCCCCACCCC | 10 | 1525 | 1544 | 168 |
| 771398 | 137 | 156 | GGCAGGAGCGGCGGCGGCCC | 48 | 1632 | 1651 | 15 |
| 771399 | 142 | 161 | GCCCGGGCAGGAGCGGCGGC | 33 | 1637 | 1656 | 169 |
| 771401 | 167 | 186 | GCAGGCGACAGCAGCAGCAG | 21 | 1662 | 1681 | 170 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771402 | 172 | 191 | CAGGCGCAGGCGACAGCAGC | 31 | 1667 | 1686 | 171 |
| 483665 | 224 | 243 | GCGAACATGACCTCCGCACA | 55 | 1719 | 1738 | 16 |
| 771405 | 225 | 244 | AGCGAACATGACCTCCGCAC | 25 | 1720 | 1739 | 172 |
| 771407 | 228 | 247 | AGGAGCGAACATGACCTCCG | 59 | 1723 | 1742 | 173 |
| 771408 | 233 | 252 | TGCTAAGGAGCGAACATGAC | 36 | 1728 | 1747 | 174 |
| 771412 | 395 | 414 | TCGCCCCTTCTCCCCGCAGC | 38 | 1890 | 1909 | 17 |
| 771413 | 401 | 420 | TGTCCGTCGCCCCTTCTCCC | 24 | 1896 | 1915 | 175 |
| 771415 | 411 | 430 | TGCGCTCGGCTGTCCGTCGC | 36 | 1906 | 1925 | 176 |
| 771416 | 416 | 435 | CCCCATGCGCTCGGCTGTCC | 58 | 1911 | 1930 | 177 |
| 771420 | 436 | 455 | GCCCGGGCCGCCGCCACCGG | 54 | 1931 | 1950 | 18 |
| 771421 | 441 | 460 | GCCCTGCCCGGGCCGCCGCC | 0 | 1936 | 1955 | 178 |
| 771423 | 451 | 470 | GCAGCATCCAGCCCTGCCCG | 39 | 1946 | 1965 | 179 |
| 771424 | 456 | 475 | CCCAGGCAGCATCCAGCCCT | 36 | 1951 | 1970 | 180 |
| 771428 | 476 | 495 | TGGCACCTCGCACCGCCTTG | 47 | 1971 | 1990 | 19 |
| 771429 | 481 | 500 | ACCTTTGGCACCTCGCACCG | 11 | 1976 | 1995 | 181 |
| 771431 | 529 | 548 | GCCCCCGGCCGCGCCGGCGC | 37 | 2024 | 2043 | 182 |
| 771432 | 577 | 596 | CAGTTTCTTGAGCACCGAGT | 28 | 2072 | 2091 | 183 |
| 771436 | 604 | 623 | GAGCAGCAGCTCCAGCTGCC | 27 | 2099 | 2118 | 20 |
| 771437 | 609 | 628 | GCCTGGAGCAGCAGCTCCAG | 0 | 2104 | 2123 | 184 |
| 771439 | 705 | 724 | GGCTGCGCGCCGGCGGGCGC | 48 | 2200 | 2219 | 185 |
| 771440 | 715 | 734 | CGGCTGCGCAGGCTGCGCGC | 48 | 2210 | 2229 | 186 |
| 771444 | 798 | 817 | AGCCTCTTGACTTCCGAGGA | 67 | 2293 | 2312 | 21 |
| 483663 | 799 | 818 | CAGCCTCTTGACTTCCGAGG | 56 | 2294 | 2313 | 22 |
| 771445 | 800 | 819 | ACAGCCTCTTGACTTCCGAG | 10 | 2295 | 2314 | 187 |
| 771447 | 803 | 822 | AACACAGCCTCTTGACTTCC | 19 | 2298 | 2317 | 188 |
| 771448 | 871 | 890 | GAGTCGGCTAAGGTGATGGG | 29 | 2366 | 2385 | 189 |
| 771691 | N/A | N/A | CCAGGAGGGTATGCACACTC | 71 | 2494<br>2516<br>2538 | 2513<br>2535<br>2557 | 66 |
| 771692 | N/A | N/A | CCCAGGAGGGTATGCACACT | 18 | 2495<br>2517<br>2539 | 2514<br>2536<br>2558 | 190 |
| 771694 | N/A | N/A | CTCCCAGGAGGGTATGCACA | 0 | 2497<br>2519 | 2516<br>2538 | 191 |
| 771695 | N/A | N/A | TCTCCCAGGAGGGTATGCAC | 22 | 2498<br>2520 | 2517<br>2539 | 192 |
| 771699 | N/A | N/A | TGCACACTCTCCCAGGAGGG | 84 | 2505<br>2527 | 2524<br>2546 | 86 |
| 771700 | N/A | N/A | TATGCACACTCTCCCAGGAG | 9 | 2507<br>2529 | 2526<br>2548 | 193 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771702 | N/A | N/A | AGGGTATGCACACTCTCCCA | 24 | 2511 2533 | 2530 2552 | 194 |
| 771703 | N/A | N/A | GGAGGGTATGCACACTCTCC | 31 | 2513 2535 | 2532 2554 | 195 |
| 771346 | N/A | N/A | CGTGATTCTCCGTATTTACT | 22 | 2874 | 2893 | 196 |
| 771350 | N/A | N/A | TTTGCCCCAAAACTCCAAAG | 28 | 2933 | 2952 | 23 |
| 771351 | N/A | N/A | CTCTCTTTGCCCCAAAACTC | 11 | 2938 | 2957 | 197 |
| 771353 | N/A | N/A | TTCCATCCAACTCTCTTTGC | 0 | 2948 | 2967 | 198 |
| 771354 | N/A | N/A | CGGCCTTCCATCCAACTCTC | 39 | 2953 | 2972 | 199 |
| 771707 | N/A | N/A | TTGTTCCTCTGCACCCTGGG | 42 | 3007 | 3026 | 24 |
| 771708 | N/A | N/A | GGATAAAAGGAAAGGAGTTT | 0 | 3167 | 3186 | 200 |
| 771710 | N/A | N/A | GGGCTGCCCATTCCTAGCGC | 40 | 3312 | 3331 | 201 |
| 771711 | N/A | N/A | CGCACTTCACAGTTCACAGG | 57 | 3476 | 3495 | 202 |
| 771452 | 911 | 930 | GGTATCTGGAGTAAGGAGGG | 55 | 3780 | 3799 | 25 |
| 771715 | N/A | N/A | AGTCTCCGAGTTATCCCCAT | 67 | 4142 | 4161 | 26 |
| 771716 | N/A | N/A | TCGAATCACCCTTTCCATTA | 24 | 4190 | 4209 | 203 |
| 771718 | N/A | N/A | AAAGTTCTAGTGTCTACTCC | 29 | 4255 | 4274 | 204 |
| 771719 | N/A | N/A | ACTGACTTGCAGGTGACTGG | 35 | 4330 | 4349 | 205 |
| 771723 | N/A | N/A | CCAAGGTTACATACAACCTG | 44 | 4657 | 4676 | 27 |
| 771724 | N/A | N/A | CCTTCTCCCAGAACCTTGGC | 27 | 4737 | 4756 | 206 |
| 771726 | N/A | N/A | AGCCAAAACCCAGTCAAGTT | 19 | 5137 | 5156 | 207 |
| 771727 | N/A | N/A | AACATGGCCTTTCTTTTCTA | 0 | 5337 | 5356 | 208 |
| 771731 | N/A | N/A | AAAACTTTGTGCCTGTTTCA | 54 | 5978 | 5997 | 28 |
| 771732 | N/A | N/A | GTCATGTGAACACTCTTTCA | 36 | 6244 | 6263 | 209 |
| 771734 | N/A | N/A | CTCAAACCTTTCAGACCATC | 64 | 6416 | 6435 | 210 |
| 771735 | N/A | N/A | TGGGTCCCTCAAGAGCTCAC | 38 | 6463 | 6482 | 211 |
| 771739 | N/A | N/A | TTTGAAAACCCAACCCTGGG | 33 | 7243 | 7262 | 29 |
| 771740 | N/A | N/A | GCCACTCCTGACTCACGCAA | 20 | 7350 | 7369 | 212 |
| 771742 | N/A | N/A | AGACAGATCTCTGAAGTCAG | 44 | 7437 | 7456 | 213 |
| 771743 | N/A | N/A | GCCATACCTCCATCTCTCAC | 0 | 7476 | 7495 | 214 |
| 771747 | N/A | N/A | GTGTGTTTCAAAGGAAAAGC | 10 | 7881 | 7900 | 30 |
| 771748 | N/A | N/A | ACCCCCACATTAAACATAAT | 0 | 7956 | 7975 | 215 |
| 771750 | N/A | N/A | GGACAACTTTTCAAGAACTC | 29 | 8281 | 8300 | 216 |
| 771751 | N/A | N/A | TGGCCATGCTGGCAAATAGG | 25 | 8465 | 8484 | 217 |
| 771755 | N/A | N/A | AAACATTTGGCACCCAACAC | 35 | 8898 | 8917 | 31 |
| 771756 | N/A | N/A | CCAGGCAACCCCAGACCTGC | 11 | 8945 | 8964 | 218 |
| 771758 | N/A | N/A | ATTACCAGTCCCCCATTACG | 0 | 9362 | 9381 | 219 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771759 | N/A | N/A | GCATTACCAGTCCCCCATTA | 26 | 9364 | 9383 | 220 |
| 771358 | N/A | N/A | AGTTAATCATTACTCGAGTC | 36 | 9415 | 9434 | 32 |
| 771359 | N/A | N/A | GTCACCCGTCTGGGCTCCGG | 15 | 9441 | 9460 | 221 |
| 771361 | N/A | N/A | ACAGCACCTTGTCACCCGTC | 27 | 9451 | 9470 | 222 |
| 771362 | N/A | N/A | GTAAGACAGACCACAGCACC | 15 | 9463 | 9482 | 223 |
| 771366 | N/A | N/A | TGCTGATTATTAATGGTCTG | 0 | 9503 | 9522 | 33 |
| 771367 | N/A | N/A | CTTGATGCTGATTATTAATG | 0 | 9508 | 9527 | 224 |
| 771369 | N/A | N/A | CAAAAGGCTGACTCGCGGCC | 22 | 9527 | 9546 | 225 |
| 771370 | N/A | N/A | CATTCCAAAAGGCTGACTCG | 18 | 9532 | 9551 | 226 |
| 771374 | N/A | N/A | AGCATGAAAGACAAACCACA | 51 | 9552 | 9571 | 34 |
| 771375 | N/A | N/A | CTAAACAGCATGAAAGACAA | 4 | 9558 | 9577 | 227 |
| 771377 | N/A | N/A | TAAGCACGCTCTAAACAGCA | 0 | 9568 | 9587 | 228 |
| 771378 | N/A | N/A | ATCTTTAAGCACGCTCTAAA | 22 | 9573 | 9592 | 229 |
| 771382 | N/A | N/A | AAATAAAAACACCAAGATCC | 0 | 9593 | 9612 | 35 |
| 771383 | N/A | N/A | TACACAAATAAAAACACCAA | 0 | 9598 | 9617 | 230 |
| 771385 | N/A | N/A | CAGTCTGCTGTGGATTTGAA | 25 | 9639 | 9658 | 231 |
| 771386 | N/A | N/A | CTGGACAGTCTGCTGTGGAT | 57 | 9644 | 9663 | 232 |
| 771763 | N/A | N/A | CCCCGTCCACGGAACGGATC | 45 | 9930 | 9949 | 36 |
| 771764 | N/A | N/A | ACACTTCACACACCAAAGCA | 20 | 9971 | 9990 | 233 |
| 771766 | N/A | N/A | CTGAAGCCCCCAAGCCAGG | 5 | 10014 | 10033 | 234 |
| 771767 | N/A | N/A | CCTAAAGGTGGGTCCATTCC | 16 | 10113 | 10132 | 235 |
| 771771 | N/A | N/A | CAGCTCCTACTGTTGGCAGT | 22 | 10275 | 10294 | 37 |
| 771772 | N/A | N/A | TCCTCAGGAACAACAATGCT | 27 | 10407 | 10426 | 236 |
| 771774 | N/A | N/A | GAAAAACAGGTAGAAATAGG | 14 | 10503 | 10522 | 237 |
| 771775 | N/A | N/A | AATGCCAAATGCCCAAAACT | 41 | 10607 | 10626 | 238 |
| 771779 | N/A | N/A | ACACACTGCTGCCTTTTCTC | 33 | 11011 | 11030 | 38 |
| 771780 | N/A | N/A | ACAAACCTTCCGAAAGGACC | 20 | 11230 | 11249 | 239 |
| 771782 | N/A | N/A | TAGGACTGGAAGAGCTTTGG | 50 | 11759 | 11778 | 240 |
| 771783 | N/A | N/A | CCCTTCAGAGAGTCACTGCT | 49 | 11873 | 11892 | 241 |
| 771787 | N/A | N/A | AAGAAGAAGGAGCTCAAACT | 27 | 11997 | 12016 | 39 |
| 771788 | N/A | N/A | CCAACTCTGAACGGAAAGAA | 30 | 12012 | 12031 | 242 |
| 771790 | N/A | N/A | CAAAACTCTCTGCCCTGGAC | 36 | 12196 | 12215 | 243 |
| 771791 | N/A | N/A | GAGGAGGGAGAAACTCCTCA | 22 | 12407 | 12426 | 244 |
| 771795 | N/A | N/A | CGTCTGCGGCAAAACCCACC | 59 | 13057 | 13076 | 40 |
| 771796 | N/A | N/A | GTTTGCGCACGGGATTGTCT | 16 | 13084 | 13103 | 245 |
| 771798 | N/A | N/A | GACACATCCATGTCCAAGCA | 17 | 13321 | 13340 | 246 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771799 | N/A | N/A | CTTCCAACACATGCTCTGCA | 57 | 13457 | 13476 | 247 |
| 771803 | N/A | N/A | ATGGATACTGACTCAAGGAC | 39 | 13937 | 13956 | 41 |
| 771804 | N/A | N/A | GACAGATGCCAGCAAGGATC | 17 | 13992 | 14011 | 248 |
| 771806 | N/A | N/A | ACAATGAATAATTGTTCACG | 0 | 14154 | 14173 | 249 |
| 771807 | N/A | N/A | GCCCTCACTCCACAATGGCA | 51 | 14298 | 14317 | 250 |
| 771811 | N/A | N/A | TGCCTCATTCTTTCCAGGAC | 50 | 14665 | 14684 | 42 |
| 771812 | N/A | N/A | TTAACCCCTGCCGGACTGCC | 26 | 14681 | 14700 | 251 |
| 771814 | N/A | N/A | TCCCTTTGCTGGCCCAGTTC | 39 | 14802 | 14821 | 252 |
| 771815 | N/A | N/A | CTCCCTTTTCACTGCTCCAC | 70 | 15021 | 15040 | 253 |
| 771819 | N/A | N/A | AATAGTTTTCTCTCAAATGT | 20 | 15647 | 15666 | 43 |
| 771820 | N/A | N/A | GGTCAAACTTGTGGTAAAAT | 29 | 15846 | 15865 | 254 |
| 771822 | N/A | N/A | CACCAAAACAAGTGTCTACC | 44 | 15984 | 16003 | 255 |
| 771823 | N/A | N/A | CTTCCCATGTGACCTCAGGG | 49 | 16008 | 16027 | 256 |
| 771827 | N/A | N/A | AAGGACATCACAGGGACTGG | 33 | 16679 | 16698 | 44 |
| 771828 | N/A | N/A | GCCCTAGAACTTGGGCAAGG | 8 | 16695 | 16714 | 257 |
| 771830 | N/A | N/A | TTTAGGTAGAGTGGCCGGGA | 40 | 16981 | 17000 | 258 |
| 771831 | N/A | N/A | CGATCATTTTCTACACCTTT | 66 | 17159 | 17178 | 259 |
| 771835 | N/A | N/A | AGTAAAATGGGAATAAGGC | 5 | 17567 | 17586 | 45 |
| 771836 | N/A | N/A | TGTTGAGGACTCCCCAGCCA | 28 | 17668 | 17687 | 260 |
| 771838 | N/A | N/A | GAACTCCTGCAGGATGAGGG | 53 | 17892 | 17911 | 261 |
| 771839 | N/A | N/A | CACAGCACCGTTACTGGACA | 21 | 17993 | 18012 | 262 |
| 771843 | N/A | N/A | CGCCGGCCCACCAACCTCTG | 17 | 18438 | 18457 | 46 |
| 771844 | N/A | N/A | GAAGGACCAAGTCCCTCTCC | 0 | 18557 | 18576 | 263 |
| 771846 | N/A | N/A | CATATTTGCTCCATAAACAA | 5 | 18699 | 18718 | 264 |
| 771847 | N/A | N/A | CATCACCTTCGGACAAGCCA | 53 | 18805 | 18824 | 265 |
| 771851 | N/A | N/A | GCTTTGAAAACATCCCACTT | 43 | 19314 | 19333 | 47 |
| 771852 | N/A | N/A | AGATTTAAAATTAAAAAGCA | 0 | 19411 | 19430 | 266 |
| 771854 | N/A | N/A | TCCCCGCCTTTTCTTCCTGG | 9 | 19647 | 19666 | 267 |
| 771855 | N/A | N/A | TCCCGACTTTGCAAGATGAA | 38 | 19729 | 19748 | 268 |
| 771859 | N/A | N/A | CCAGAAAATGCAGACAGCTA | 42 | 19898 | 19917 | 48 |
| 771860 | N/A | N/A | CTGGCTCAGAGGCTGCAGTG | 20 | 20058 | 20077 | 269 |
| 771862 | N/A | N/A | TCTTCCCCAGAAAACAGCCC | 10 | 20225 | 20244 | 270 |
| 771863 | N/A | N/A | CCAGCCCCTCCTGGGACTA | 9 | 20315 | 20334 | 271 |
| 771867 | N/A | N/A | ACTGGGCTTCAGCAAAGATA | 19 | 20754 | 20773 | 49 |
| 771868 | N/A | N/A | GGAGGCAAATTCATAGACAG | 16 | 21075 | 21094 | 272 |
| 771870 | N/A | N/A | AGGCACAAGTCAAGGAGGCC | 15 | 21460 | 21479 | 273 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771871 | N/A | N/A | CTCCCTCTGCCCCAGGATTC | 15 | 21546 | 21565 | 274 |
| 771875 | N/A | N/A | CCCCGTGCACTCCCAGCCCT | 51 | 22089 | 22108 | 50 |
| 771876 | N/A | N/A | CGAGCTCCCTCCCTGGCCCC | 0 | 22112 | 22131 | 275 |
| 771878 | N/A | N/A | CAGTTTCTAGAGGGTAGGAA | 22 | 22319 | 22338 | 276 |
| 771879 | N/A | N/A | AGGACCCAAAGGCAGACCCT | 23 | 22375 | 22394 | 277 |
| 771883 | N/A | N/A | AGCTGGCACTGAATGCTGAT | 26 | 22695 | 22714 | 51 |
| 771884 | N/A | N/A | CTGCCACCCTGAGAGTGTAG | 3 | 22754 | 22773 | 278 |
| 771886 | N/A | N/A | AACCAGGTTCCCACTGTTAC | 0 | 22999 | 23018 | 279 |
| 771887 | N/A | N/A | CAGCCACTGCTGTCTGAGGA | 14 | 23199 | 23218 | 280 |
| 771891 | N/A | N/A | CTCCCAAGCCTACATATTTC | 56 | 23560 | 23579 | 52 |
| 771892 | N/A | N/A | CTGAAGTTTCTCCTCCCATC | 2 | 23599 | 23618 | 281 |
| 771894 | N/A | N/A | CAAAAGGGAAAGGAGGTTTG | 17 | 23794 | 23813 | 282 |
| 771895 | N/A | N/A | ATTTGCAACAATAAAACAAA | 0 | 23821 | 23840 | 283 |
| 771899 | N/A | N/A | CCTGATTGTCTCCACATCCC | 47 | 24447 | 24466 | 53 |
| 771900 | N/A | N/A | ATGCCCACCAGTCTTCCTGA | 32 | 24462 | 24481 | 284 |
| 771902 | N/A | N/A | GGGTTCTCCAGCCGCTCAGA | 77 | 24484 | 24503 | 285 |
| 771903 | N/A | N/A | TGCCAACCCCAGAGGTGAGC | 20 | 24698 | 24717 | 286 |
| 771907 | N/A | N/A | TCTATTCTCACGCCAAACCA | 28 | 25268 | 25287 | 85 |
| 771908 | N/A | N/A | CAAACATCACCACGCCTCGC | 26 | 25500 | 25519 | 287 |
| 771910 | N/A | N/A | AGGCACGGCCGCCTCCTGCA | 4 | 25598 | 25617 | 288 |
| 771911 | N/A | N/A | ATGGTCCAGCAGAGCAGAAG | 20 | 25657 | 25676 | 289 |
| 771915 | N/A | N/A | CTGGGCCCAGACACACAAAG | 27 | 25941 | 25960 | 74 |
| 771916 | N/A | N/A | CCTTCTTAAATTTTTAATTT | 0 | 26141 | 26160 | 290 |
| 771918 | N/A | N/A | AAGGCCACATTTTAGGTTAA | 12 | 26487 | 26506 | 291 |
| 771919 | N/A | N/A | CAATGGCACAGGGTGACCAG | 29 | 26512 | 26531 | 292 |
| 771923 | N/A | N/A | CCCCAGAAAACTGTACAGGG | 46 | 26950 | 26969 | 68 |
| 771924 | N/A | N/A | TCGCTGATAGTTAACCTCTG | 9 | 27049 | 27068 | 293 |
| 771926 | N/A | N/A | ACAAAGGTCTGTGTGGACGC | 13 | 27153 | 27172 | 294 |
| 771927 | N/A | N/A | GCCCACAGCCCACACGAGTC | 0 | 27178 | 27197 | 295 |
| 771931 | N/A | N/A | CCCAGCCCAGAAAACTGCA | 36 | 27602 | 27621 | 67 |
| 771932 | N/A | N/A | CGAGGTGCCCCCATGCCAGG | 13 | 27830 | 27849 | 296 |
| 771934 | N/A | N/A | CTGGAAAGGAAGACTCGAGG | 15 | 28010 | 28029 | 297 |
| 771935 | N/A | N/A | GGAAGGACACATTGGCATCA | 23 | 28158 | 28177 | 298 |
| 771939 | N/A | N/A | TTCCCTACAGACACCCCAAG | 33 | 28589 | 28608 | 89 |
| 771940 | N/A | N/A | TCCTGCTGCCCCAGCAGGCT | 0 | 28823 | 28842 | 299 |
| 771942 | N/A | N/A | GTCGGTCAGGGCCTTGCCCT | 11 | 29013 | 29032 | 300 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771943 | N/A | N/A | GTATTTGTTAACAAAAATGG | 0 | 29072 | 29091 | 301 |
| 771947 | N/A | N/A | TTAACCCGGGCTACCTTAAC | 26 | 29533 | 29552 | 88 |
| 771948 | N/A | N/A | CACCCAGCTCTCAAATCAGT | 0 | 29718 | 29737 | 302 |
| 771950 | N/A | N/A | ATGCAAAGGGACCCTTAATA | 0 | 29971 | 29990 | 303 |
| 771951 | N/A | N/A | CTGCAGAGCACAGATGCAAA | 9 | 29984 | 30003 | 304 |
| 771460 | 1081 | 1100 | CGTCTTCTCCTCCCAGTATG | 36 | 30348 | 30367 | 70 |
| 771461 | 1099 | 1118 | GTAGAGCCTCCCCACTCTCG | 37 | 30366 | 30385 | 305 |
| 771463 | 1113 | 1132 | GGCTCCTGGACACAGTAGAG | 10 | 30380 | 30399 | 306 |
| 771464 | 1118 | 1137 | GAGAGGGCTCCTGGACACAG | 55 | 30385 | 30404 | 307 |
| 771468 | 1198 | 1217 | CACCAGCTGACTCTTGTTGT | 12 | 30465 | 30484 | 65 |
| 771469 | 1203 | 1222 | TTCTGCACCAGCTGACTCTT | 13 | 30470 | 30489 | 308 |
| 771471 | 1213 | 1232 | GCTCCGCACCTTCTGCACCA | 43 | 30480 | 30499 | 309 |
| 771472 | 1218 | 1237 | ATTTTGCTCCGCACCTTCTG | 0 | 30485 | 30504 | 310 |
| 771476 | 1258 | 1277 | CACACCATCCACCTCCCGCG | 39 | 30525 | 30544 | 63 |
| 771477 | 1274 | 1293 | TGCGGTTGTACACCCACACA | 20 | 30541 | 30560 | 311 |
| 771479 | 1353 | 1372 | GGGAACACCTTGTGTACCAA | 58 | 30620 | 30639 | 312 |
| 771480 | 1372 | 1391 | AGCCTTGATGGAGAAACCGG | 46 | 30639 | 30658 | 313 |
| 771484 | 1441 | 1460 | CGTCCACGGCTGCTGCATAA | 30 | 30708 | 30727 | 69 |
| 771485 | 1446 | 1465 | AAGCCCGTCCACGGCTGCTG | 15 | 30713 | 30732 | 314 |
| 771487 | 1456 | 1475 | CTGCACGGTAAAGCCCGTCC | 45 | 30723 | 30742 | 315 |
| 771488 | 1461 | 1480 | CTGATCTGCACGGTAAAGCC | 53 | 30728 | 30747 | 316 |
| 771492 | 1510 | 1529 | GCTGCTGATGAACTGGCGGG | 56 | 30777 | 30796 | 80 |
| 771493 | 1516 | 1535 | CGGGCAGCTGCTGATGAACT | 17 | 30783 | 30802 | 317 |
| 771495 | 1526 | 1545 | CTAGCCAGCACGGGCAGCTG | 18 | 30793 | 30812 | 318 |
| 771496 | 1532 | 1551 | TGACCTCTAGCCAGCACGGG | 20 | 30799 | 30818 | 319 |
| 771500 | 1555 | 1574 | ACGCGGCTACCGGCTGTTGA | 32 | 30822 | 30841 | 58 |
| 771501 | 1557 | 1576 | GCACGCGGCTACCGGCTGTT | 16 | 30824 | 30843 | 320 |
| 771503 | 1577 | 1596 | GCTCACGCTCTGTCCCCTCC | 27 | 30844 | 30863 | 321 |
| 771504 | 1579 | 1598 | CAGCTCACGCTCTGTCCCCT | 48 | 30846 | 30865 | 322 |
| 771507 | 1584 | 1603 | CTGCTCAGCTCACGCTCTGT | 47 | 30851 | 30870 | 73 |
| 771508 | 1585 | 1604 | CCTGCTCAGCTCACGCTCTG | 8 | 30852 | 30871 | 323 |
| 771510 | 1592 | 1611 | AGTGTGGCCTGCTCAGCTCA | 35 | 30859 | 30878 | 324 |
| 771511 | 1597 | 1616 | TTTGAAGTGTGGCCTGCTCA | 31 | 30864 | 30883 | 325 |
| 771515 | 1617 | 1636 | AAATATTAGCAGCAAAGTAG | 28 | 30884 | 30903 | 56 |
| 771516 | 1622 | 1641 | GAGGAAAATATTAGCAGCAA | 8 | 30889 | 30908 | 326 |
| 771518 | 1632 | 1651 | AAGCACTCAGGAGGAAAATA | 4 | 30899 | 30918 | 327 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 771519 | 1637 | 1656 | AAAGCAAGCACTCAGGAGGA | 25 | 30904 | 30923 | 328 |
| 771523 | 1644 | 1663 | TGCATGAAAAGCAAGCACTC | 43 | 30911 | 30930 | 87 |
| 771524 | 1645 | 1664 | TTGCATGAAAAGCAAGCACT | 19 | 30912 | 30931 | 329 |
| 771526 | 1647 | 1666 | GTTTGCATGAAAAGCAAGCA | 26 | 30914 | 30933 | 330 |
| 771527 | 1649 | 1668 | GAGTTTGCATGAAAAGCAAG | 0 | 30916 | 30935 | 331 |
| 771531 | 1665 | 1684 | AAAAAAAACGACCAAAGAGT | 32 | 30932 | 30951 | 54 |
| 771532 | 1689 | 1708 | AGAAGAAAACCAACCAACAA | 0 | 30956 | 30975 | 332 |
| 771534 | 1713 | 1732 | AACAGAACACAAACGAGGAC | 0 | 30980 | 30999 | 333 |
| 771535 | 1718 | 1737 | AACAAAACAGAACACAAACG | 17 | 30985 | 31004 | 334 |
| 771539 | 1738 | 1757 | AGCTATTTCTCAAAGAGCGA | 56 | 31005 | 31024 | 60 |
| 771540 | 1743 | 1762 | TCATAAGCTATTTCTCAAAG | 0 | 31010 | 31029 | 335 |
| 771542 | 1753 | 1772 | ACAATTCTTTTCATAAGCTA | 0 | 31020 | 31039 | 336 |
| 771543 | 1758 | 1777 | CCCCAACAATTCTTTTCATA | 36 | 31025 | 31044 | 337 |
| 771547 | 1798 | 1817 | GTGTCCTGCCGATCATACCT | 35 | 31065 | 31084 | 82 |
| 771548 | 1799 | 1818 | GGTGTCCTGCCGATCATACC | 19 | 31066 | 31085 | 338 |
| 771550 | 1820 | 1839 | TGCTTCCCCTCTTCCTATCA | 4 | 31087 | 31106 | 339 |
| 771551 | 1825 | 1844 | ATTTCTGCTTCCCTCTTCC | 18 | 31092 | 31111 | 340 |
| 771555 | 1841 | 1860 | GTTTGGTGGTGCTTGGATTT | 56 | 31108 | 31127 | 83 |
| 771556 | 1856 | 1875 | CCCTTCATACACTGTGTTTG | 30 | 31123 | 31142 | 341 |
| 771558 | 1871 | 1890 | AAATGATGACCGCCCCCCTT | 7 | 31138 | 31157 | 342 |
| 771559 | 1876 | 1895 | AAGTGAAATGATGACCGCCC | 49 | 31143 | 31162 | 343 |
| 771563 | 1893 | 1912 | TCACACACACTCCTGACAAG | 23 | 31160 | 31179 | 84 |
| 771564 | 1908 | 1927 | GCCGCACACTCACACTCACA | 28 | 31175 | 31194 | 344 |
| 771566 | 1970 | 1989 | GACACAAAACAAAGAGCACG | 28 | 31237 | 31256 | 345 |
| 771567 | 1985 | 2004 | GGGACATCCATAAGAGACAC | 39 | 31252 | 31271 | 346 |
| 771571 | 2009 | 2028 | TTGGGACTGCAAACCTCTCT | 42 | 31276 | 31295 | 90 |
| 771572 | 2010 | 2029 | CTTGGGACTGCAAACCTCTC | 37 | 31277 | 31296 | 347 |
| 771574 | 2012 | 2031 | CGCTTGGGACTGCAAACCTC | 66 | 31279 | 31298 | 348 |
| 771575 | 2014 | 2033 | ACCGCTTGGGACTGCAAACC | 47 | 31281 | 31300 | 349 |
| 771579 | 2061 | 2080 | AGGTACTGCCTCTGCCCCAC | 62 | 31328 | 31347 | 61 |
| 771580 | 2070 | 2089 | AGCTTGCCCAGGTACTGCCT | 25 | 31337 | 31356 | 350 |
| 771582 | 2097 | 2116 | CTGGCAGCTGCTGGGACCCC | 37 | 31364 | 31383 | 351 |
| 771583 | 2102 | 2121 | TGCTCCTGGCAGCTGCTGGG | 57 | 31369 | 31388 | 352 |
| 771587 | 2160 | 2179 | CGTGTCCTTGATGAGGGAGA | 42 | 31427 | 31446 | 71 |
| 771588 | 2165 | 2184 | AGGCCCGTGTCCTTGATGAG | 13 | 31432 | 31451 | 353 |
| 771590 | 2175 | 2194 | GCCTGTGGACAGGCCCGTGT | 14 | 31442 | 31461 | 354 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771591 | 2180 | 2199 | CAGAAGCCTGTGGACAGGCC | 50 | 31447 | 31466 | 355 |
| 771595 | 2217 | 2236 | AATTGGTTCTGGTTCGGCCA | 36 | 31484 | 31503 | 57 |
| 771596 | 2232 | 2251 | GACAAGGATGAAAATAATTG | 0 | 31499 | 31518 | 356 |
| 771598 | 2243 | 2262 | GAAGGGAATAAGACAAGGAT | 34 | 31510 | 31529 | 357 |
| 771599 | 2247 | 2266 | GCAGGAAGGGAATAAGACAA | 39 | 31514 | 31533 | 358 |
| 771603 | 2306 | 2325 | CTCAGGGAGATCCAGGAGCA | 26 | 31573 | 31592 | 72 |
| 771604 | 2321 | 2340 | CCTTGGGAAGCCCATCTCAG | 12 | 31588 | 31607 | 359 |
| 771606 | 2337 | 2356 | GGGCTGCCCCGGCAGCCCTT | 0 | 31604 | 31623 | 360 |
| 771607 | 2356 | 2375 | GGTGAGCAATACTGTGAGGG | 34 | 31623 | 31642 | 361 |
| 771611 | 2412 | 2431 | GAAAAACCTGATGTCACCAG | 69 | 31679 | 31698 | 77 |
| 771612 | 2417 | 2436 | TCCGGGAAAACCTGATGTC | 3 | 31684 | 31703 | 362 |
| 771614 | 2427 | 2446 | GTTTTCTAAGTCCGGGAAAA | 25 | 31694 | 31713 | 363 |
| 771615 | 2432 | 2451 | AGCTGGTTTTCTAAGTCCGG | 45 | 31699 | 31718 | 364 |
| 771619 | 2457 | 2476 | CACAGGATGGGAGCAGGCAG | 48 | 31724 | 31743 | 64 |
| 771620 | 2459 | 2478 | CACACAGGATGGGAGCAGGC | 12 | 31726 | 31745 | 365 |
| 771622 | 2461 | 2480 | AACACACAGGATGGGAGCAG | 34 | 31728 | 31747 | 366 |
| 771623 | 2462 | 2481 | TAACACACAGGATGGGAGCA | 51 | 31729 | 31748 | 367 |
| 771627 | 2485 | 2504 | CTTGCTGGCCTAATAGCAGA | 27 | 31752 | 31771 | 75 |
| 771628 | 2500 | 2519 | CCAGGGACATCCCCGCTTGC | 12 | 31767 | 31786 | 368 |
| 771630 | 2517 | 2536 | TGCTAAGCATGTCCCTCCCA | 37 | 31784 | 31803 | 369 |
| 771631 | 2522 | 2541 | GGGACTGCTAAGCATGTCCC | 0 | 31789 | 31808 | 370 |
| 771635 | 2556 | 2575 | GGTTATGACGGACCAAATCC | 55 | 31823 | 31842 | 81 |
| 771636 | 2561 | 2580 | CCTTGGGTTATGACGGACCA | 0 | 31828 | 31847 | 371 |
| 771638 | 2571 | 2590 | TAGGATGGTACCTTGGGTTA | 41 | 31838 | 31857 | 372 |
| 771639 | 2576 | 2595 | CAGCCTAGGATGGTACCTTG | 51 | 31843 | 31862 | 373 |
| 771643 | 2596 | 2615 | ATGAAAGAAGAGTTAGGTGT | 22 | 31863 | 31882 | 62 |
| 771644 | 2602 | 2621 | GAAGAAATGAAAGAAGAGTT | 0 | 31869 | 31888 | 374 |
| 771646 | 2613 | 2632 | TATGAGTTGTAGAAGAAATG | 0 | 31880 | 31899 | 375 |
| 771647 | 2618 | 2637 | GAGTGTATGAGTTGTAGAAG | 6 | 31885 | 31904 | 376 |
| 771651 | 2645 | 2664 | GCTAAGAACAGTGTCGAAGT | 33 | 31912 | 31931 | 79 |
| 771652 | 2650 | 2669 | ATTGAGCTAAGAACAGTGTC | 0 | 31917 | 31936 | 377 |
| 771654 | 2660 | 2679 | AAACATGCTCATTGAGCTAA | 32 | 31927 | 31946 | 378 |
| 771655 | 2665 | 2684 | AGTCTAAACATGCTCATTGA | 14 | 31932 | 31951 | 379 |
| 771659 | 2685 | 2704 | AGAAAAATAGCTTATGTTAA | 0 | 31952 | 31971 | 59 |
| 771660 | 2714 | 2733 | TTCTCTTGTTCATTTAAACC | 0 | 31981 | 32000 | 380 |
| 771662 | 2724 | 2743 | ATGAGAATGCTTCTCTTGTT | 29 | 31991 | 32010 | 381 |

TABLE 3-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771663 | 2729 | 2748 | TTCCAATGAGAATGCTTCTC | 56 | 31996 | 32015 | 382 |
| 771667 | 2749 | 2768 | AAAGCACTACAATGCTAAAT | 29 | 32016 | 32035 | 55 |
| 771668 | 2754 | 2773 | CTCTCAAAGCACTACAATGC | 9 | 32021 | 32040 | 383 |
| 771670 | 2764 | 2783 | AGTCCTTTCTCTCTCAAAGC | 46 | 32031 | 32050 | 384 |
| 771671 | 2769 | 2788 | TCAGGAGTCCTTTCTCTCTC | 69 | 32036 | 32055 | 385 |
| 771675 | 2793 | 2812 | CTTTAATAAATCTCAGGTTT | 24 | 32060 | 32079 | 89 |
| 771676 | 2895 | 2914 | TGTTTATACACATTGCACAA | 2 | 32162 | 32181 | 386 |
| 771678 | 2905 | 2924 | TTATTTTCTTGTTTATACA | 0 | 32172 | 32191 | 387 |
| 771679 | 2916 | 2935 | GCATCTTTTCTTTATTTTC | 0 | 32183 | 32202 | 388 |
| 771683 | 2950 | 2969 | GCATTTGTTATTTGCATTTA | 0 | 32217 | 32236 | 78 |
| 771684 | 2955 | 2974 | ATTTGGCATTTGTTATTTGC | 0 | 32222 | 32241 | 389 |
| 771686 | 2969 | 2988 | GTTTATCTTTTTAATTTGG | 0 | 32236 | 32255 | 390 |
| 771687 | 2974 | 2993 | CTTGTGTTTATCTTTTTAA | 13 | 32241 | 32260 | 391 |
| 582468 | N/A | N/A | GCCAATATCATAACCCAAGC | 4 | N/A | N/A | 392 |
| 771453 | 949 | 968 | ATCTGGACAGTCTGCAGTTG | 38 | N/A | N/A | 393 |

TABLE 4

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771388 | 1 | 20 | GCGCCCTGCGCGGCTCTCCG | 31 | 1496 | 1515 | 394 |
| 771389 | 16 | 35 | CACCCCGCGCGGCCCGCGCC | 18 | 1511 | 1530 | 395 |
| 771395 | 31 | 50 | GCGCTCCGGCTGCCCCACCC | 0 | 1526 | 1545 | 396 |
| 771396 | 33 | 52 | CTGCGCTCCGGCTGCCCCAC | 48 | 1528 | 1547 | 397 |
| 771397 | 132 | 151 | GAGCGGCGGCGGCCCGAGGG | 55 | 1627 | 1646 | 398 |
| 278478 | 220 | 239 | ACATGACCTCCGCACACCAT | 18 | 1715 | 1734 | 399 |
| 771403 | 222 | 241 | GAACATGACCTCCGCACACC | 62 | 1717 | 1736 | 400 |
| 771404 | 223 | 242 | CGAACATGACCTCCGCACAC | 51 | 1718 | 1737 | 401 |
| 771409 | 356 | 375 | CCCCTGCGCCCTCCTCCTCG | 19 | 1851 | 1870 | 402 |
| 771410 | 377 | 396 | GCTCGCCTCCTCCTCCACCT | 37 | 1872 | 1891 | 403 |
| 771411 | 390 | 409 | CCTTCTCCCCGCAGCTCGCC | 33 | 1885 | 1904 | 404 |
| 771417 | 421 | 440 | ACCGGCCCCATGCGCTCGGC | 16 | 1916 | 1935 | 405 |
| 771418 | 426 | 445 | CCGCCACCGGCCCCATGCGC | 60 | 1921 | 1940 | 406 |
| 771419 | 431 | 450 | GGCCGCCGCCACCGGCCCCA | 37 | 1926 | 1945 | 407 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771425 | 461 | 480 | CCTTGCCCAGGCAGCATCCA | 1 | 1956 | 1975 | 408 |
| 771426 | 466 | 485 | CACCGCCTTGCCCAGGCAGC | 28 | 1961 | 1980 | 409 |
| 771427 | 471 | 490 | CCTCGCACCGCCTTGCCCAG | 36 | 1966 | 1985 | 410 |
| 771433 | 582 | 601 | TCCTTCAGTTTCTTGAGCAC | 0 | 2077 | 2096 | 411 |
| 771434 | 587 | 606 | GCCGCTCCTTCAGTTTCTTG | 27 | 2082 | 2101 | 412 |
| 771435 | 592 | 611 | CAGCTGCCGCTCCTTCAGTT | 29 | 2087 | 2106 | 413 |
| 771441 | 721 | 740 | CGAGGGCGGCTGCGCAGGCT | 10 | 2216 | 2235 | 414 |
| 771442 | 795 | 814 | CTCTTGACTTCCGAGGAATG | 22 | 2290 | 2309 | 415 |
| 771443 | 797 | 816 | GCCTCTTGACTTCCGAGGAA | 30 | 2292 | 2311 | 416 |
| 483663 | 799 | 818 | CAGCCTCTTGACTTCCGAGG | 41 | 2294 | 2313 | 22 |
| 771449 | 876 | 895 | TCGCAGAGTCGGCTAAGGTG | 0 | 2371 | 2390 | 417 |
| 771450 | 881 | 900 | CTAGTTCGCAGAGTCGGCTA | 45 | 2376 | 2395 | 418 |
| 771690 | N/A | N/A | CCTAGTTCGCAGAGTCGGCT | 43 | 2377 | 2396 | 419 |
| 771696 | N/A | N/A | CTCTCCCAGGAGGGTATGCA | 0 | 2499 2521 | 2518 2540 | 420 |
| 771697 | N/A | N/A | CACTCTCCCAGGAGGGTATG | 5 | 2501 2523 | 2520 2542 | 421 |
| 771698 | N/A | N/A | CACACTCTCCCAGGAGGGTA | 43 | 2503 2525 | 2522 2544 | 422 |
| 771704 | N/A | N/A | CAGGAGGGTATGCACACTCT | 32 | 2515 2537 | 2534 2556 | 423 |
| 771705 | N/A | N/A | AATGCCCTTTGAGTTTCCCC | 52 | 2593 | 2612 | 424 |
| 771706 | N/A | N/A | GGGCCTGGACCAAATCCAAC | 22 | 2793 | 2812 | 425 |
| 771347 | N/A | N/A | TGGGCCACTGGTGTTCGACG | 0 | 2892 | 2911 | 426 |
| 771348 | N/A | N/A | GGCCACGACAGTATCTGGGC | 42 | 2907 | 2926 | 427 |
| 771349 | N/A | N/A | ACTCCAAAGGTGCGCGGCCA | 26 | 2922 | 2941 | 428 |
| 771355 | N/A | N/A | CAGTTCGGCCTTCCATCCAA | 0 | 2958 | 2977 | 429 |
| 771712 | N/A | N/A | ATTCTTTTAGCCCAACTGTT | 3 | 3676 | 3695 | 430 |
| 771713 | N/A | N/A | TGCCTACACACAAAAAGCCA | 15 | 3886 | 3905 | 431 |
| 771714 | N/A | N/A | TCTGGACTAAAGCTTCCACG | 44 | 4088 | 4107 | 432 |
| 771720 | N/A | N/A | CAGGCAGAGCTATGCTTCAA | 20 | 4396 | 4415 | 433 |
| 771721 | N/A | N/A | CCCAGCACTGTGATGTCCAG | 43 | 4537 | 4556 | 434 |
| 771722 | N/A | N/A | AGAGGGAGCTCCAGGAATTT | 10 | 4604 | 4623 | 435 |
| 771728 | N/A | N/A | AACTTTTCTCCCCCTTGGAA | 1 | 5537 | 5556 | 436 |
| 771729 | N/A | N/A | TGCTCCAGCTCCAGACCTGG | 35 | 5747 | 5766 | 437 |
| 771730 | N/A | N/A | AATGCCCCCGGCCACAGCAG | 27 | 5811 | 5830 | 438 |
| 771736 | N/A | N/A | TGCCAGATCTCAGGTCAAGA | 0 | 6539 | 6558 | 439 |
| 771737 | N/A | N/A | TCAAATGAACCCTGGTTATA | 57 | 7043 | 7062 | 440 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771738 | N/A | N/A | GAGCTTCCTAAGTACTGTTA | 14 | 7140 | 7159 | 441 |
| 771744 | N/A | N/A | GGCTATTCCCAAGAGTCCAG | 23 | 7595 | 7614 | 442 |
| 771745 | N/A | N/A | GTGAAGAAGCAAAGTATACC | 24 | 7681 | 7700 | 443 |
| 771746 | N/A | N/A | AAGCCGGGCATCTCAGAGCA | 22 | 7865 | 7884 | 444 |
| 771752 | N/A | N/A | AATGTCCCTGTGGGTTTCCA | 0 | 8497 | 8516 | 445 |
| 771753 | N/A | N/A | GTCCATGAACCACAACTCAT | 50 | 8697 | 8716 | 446 |
| 771754 | N/A | N/A | CCCTCAGGTACTCTGCACAG | 45 | 8805 | 8824 | 447 |
| 771357 | N/A | N/A | GAGTCAGGCTCAATGAGACT | 16 | 9400 | 9419 | 448 |
| 771363 | N/A | N/A | TCAGGCTTCACTGCCCATCG | 12 | 9482 | 9501 | 449 |
| 771364 | N/A | N/A | TAATGGTCTGCTCAGGCTTC | 23 | 9493 | 9512 | 450 |
| 771365 | N/A | N/A | ATTATTAATGGTCTGCTCAG | 5 | 9498 | 9517 | 451 |
| 771371 | N/A | N/A | CCACACATTCCAAAAGGCTG | 0 | 9537 | 9556 | 452 |
| 771372 | N/A | N/A | ACAAACCACACATTCCAAAA | 37 | 9542 | 9561 | 453 |
| 771373 | N/A | N/A | GAAAGACAAACCACACATTC | 32 | 9547 | 9566 | 454 |
| 771379 | N/A | N/A | GATCCATCTTTAAGCACGCT | 0 | 9578 | 9597 | 455 |
| 771380 | N/A | N/A | ACCAAGATCCATCTTTAAGC | 0 | 9583 | 9602 | 456 |
| 771381 | N/A | N/A | AAAACACCAAGATCCATCTT | 0 | 9588 | 9607 | 457 |
| 771387 | N/A | N/A | AGCATCTGGACAGTCTGCTG | 6 | 9649 | 9668 | 458 |
| 771760 | N/A | N/A | ATCTTACCTGAAAGCCCCCC | 3 | 9714 | 9733 | 459 |
| 771761 | N/A | N/A | CCCCATTCCTCCAGTCTTTA | 33 | 9779 | 9798 | 460 |
| 771762 | N/A | N/A | GTCACCACCGATGCATCCAA | 72 | 9857 | 9876 | 461 |
| 771768 | N/A | N/A | GTATGCTTGGGATCTGTCTT | 11 | 10143 | 10162 | 462 |
| 771769 | N/A | N/A | GGCTGGGAATCAGAACTTGG | 71 | 10197 | 10216 | 463 |
| 771770 | N/A | N/A | CTGTTGGCAGTGCTCCCACC | 61 | 10266 | 10285 | 464 |
| 771776 | N/A | N/A | CTCAGCAAGCTCAGTTCCTG | 38 | 10811 | 10830 | 465 |
| 771777 | N/A | N/A | CCCTCAGTCTCAGATAACAG | 50 | 10882 | 10901 | 466 |
| 771778 | N/A | N/A | TGAGTAAACAATACCCTCAG | 66 | 10895 | 10914 | 467 |
| 771784 | N/A | N/A | TAAATCAAGAGCTGAAATTC | 0 | 11958 | 11977 | 468 |
| 771785 | N/A | N/A | ACTTTGAAGCCTTTGGAATT | 12 | 11980 | 11999 | 469 |
| 771786 | N/A | N/A | AGCTCAAACTTTGAAGCCTT | 56 | 11987 | 12006 | 470 |
| 771792 | N/A | N/A | AGCACACCCCACCCCCACCT | 2 | 12632 | 12651 | 471 |
| 771793 | N/A | N/A | AAGTCCCTAACGACCAGGCC | 58 | 12845 | 12864 | 472 |
| 771794 | N/A | N/A | GAAGCAAGTCACTGCCTTCT | 68 | 12924 | 12943 | 473 |
| 771800 | N/A | N/A | GACAGCAGACAGGCAAAATG | 12 | 13523 | 13542 | 474 |
| 771801 | N/A | N/A | ACCTACAACTCACAAGGGAG | 31 | 13572 | 13591 | 475 |
| 771802 | N/A | N/A | CCTTGAGATCCATGGGAGCA | 40 | 13737 | 13756 | 476 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771808 | N/A | N/A | CCCCAAAGTCCACGCTCATG | 32 | 14368 | 14387 | 477 |
| 771809 | N/A | N/A | ACCTGAGTCCCCCAAAGTCC | 7 | 14377 | 14396 | 478 |
| 771810 | N/A | N/A | GGCACTGCAGAAGAGGCGGG | 46 | 14594 | 14613 | 479 |
| 771816 | N/A | N/A | ATCCAACTACTCAGAGGCTG | 27 | 15227 | 15246 | 480 |
| 771817 | N/A | N/A | GGAATTATGACACAGTAACA | 19 | 15431 | 15450 | 481 |
| 771818 | N/A | N/A | TGAAGACAACTGCTTTGAGA | 38 | 15519 | 15538 | 482 |
| 771824 | N/A | N/A | TTCTACTAGAAAAAAATTAG | 0 | 16278 | 16297 | 483 |
| 771825 | N/A | N/A | CTCTCATTTCTGGAACCCAC | 76 | 16478 | 16497 | 484 |
| 771826 | N/A | N/A | CACCATCCTGGTTCGCAGTC | 31 | 16604 | 16623 | 485 |
| 771832 | N/A | N/A | ACCTTTCACGAACCACTTTT | 11 | 17364 | 17383 | 486 |
| 771833 | N/A | N/A | TTAAAGAAAATGGCCTACAT | 21 | 17456 | 17475 | 487 |
| 771834 | N/A | N/A | AACATAAAGTTCTCAAACAG | 25 | 17484 | 17503 | 488 |
| 771840 | N/A | N/A | AGATGCTTCTAGGTGAACCA | 16 | 18033 | 18052 | 489 |
| 771841 | N/A | N/A | TTTAGAAACCCAGAGACAAA | 36 | 18111 | 18130 | 490 |
| 771842 | N/A | N/A | TTGTGTTATGAAAACAAAAC | 6 | 18311 | 18330 | 491 |
| 771848 | N/A | N/A | CCACACAACCAAAGCAGAAG | 36 | 19011 | 19030 | 492 |
| 771849 | N/A | N/A | CTAGGCTGGTCACTTCCACT | 66 | 19211 | 19230 | 493 |
| 771850 | N/A | N/A | TCCCACTTCTCCTCTGGCTG | 58 | 19302 | 19321 | 494 |
| 771856 | N/A | N/A | CTGAAAGAAAGTCCCGACTT | 34 | 19740 | 19759 | 495 |
| 771857 | N/A | N/A | CGTCTTATTGTTTTGTTCC | 29 | 19850 | 19869 | 496 |
| 771858 | N/A | N/A | CTGCCAACGGCACAGTCATA | 31 | 19876 | 19895 | 497 |
| 771864 | N/A | N/A | AGACAAAGATCACAGATCAC | 0 | 20528 | 20547 | 498 |
| 771865 | N/A | N/A | ATAGGGATATCTCATCAATA | 38 | 20580 | 20599 | 499 |
| 771866 | N/A | N/A | GCATTTTCTGAACAGAGTC | 34 | 20695 | 20714 | 500 |
| 771872 | N/A | N/A | TCCCCACCGCGCAGGGACA | 0 | 21590 | 21609 | 501 |
| 771873 | N/A | N/A | AGCTGCTGTCACAAGGCCCT | 31 | 21746 | 21765 | 502 |
| 771874 | N/A | N/A | ATTACTTCTGTCTGCCTCCG | 34 | 21946 | 21965 | 503 |
| 771880 | N/A | N/A | TCCCTGGTTTTGCAGGTGGT | 29 | 22497 | 22516 | 504 |
| 771881 | N/A | N/A | ATTTTCCAAAAGGACAAAAC | 0 | 22540 | 22559 | 505 |
| 771882 | N/A | N/A | GCATCATGAAAATCTTAATA | 35 | 22583 | 22602 | 506 |
| 771888 | N/A | N/A | TCGCCATGGAGAATGTAATT | 0 | 23351 | 23370 | 507 |
| 771889 | N/A | N/A | TAAGAGCATTTATCTCGCCA | 29 | 23365 | 23384 | 508 |
| 771890 | N/A | N/A | AGTCTGAAGCCCCCAACCTG | 14 | 23399 | 23418 | 509 |
| 771896 | N/A | N/A | GGGCCCCCTTCTGCCTTCAT | 0 | 23956 | 23975 | 510 |
| 771897 | N/A | N/A | CTCTCAGGGTCTCAGTTTGA | 44 | 24021 | 24040 | 511 |
| 771898 | N/A | N/A | GGTGTGAGCTGTGGACACAG | 27 | 24221 | 24240 | 512 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771904 | N/A | N/A | CCCAACCCATCTCCACCACC | 0 | 24966 | 24985 | 513 |
| 771905 | N/A | N/A | TAGGCGAATCCCTCCCCCAA | 0 | 25208 | 25227 | 514 |
| 771906 | N/A | N/A | ACCCTTGCTGGTCTCTTGTT | 0 | 25233 | 25252 | 515 |
| 771912 | N/A | N/A | ATATTCCTCTGCCAAAGTCC | 19 | 25710 | 25729 | 516 |
| 771913 | N/A | N/A | AAAAAAGCCAGTAAAGACAT | 11 | 25860 | 25879 | 517 |
| 771914 | N/A | N/A | ATTTAGGAACAAGGGCAAGC | 34 | 25886 | 25905 | 518 |
| 771920 | N/A | N/A | TTATTTAATTACCCTGCTCA | 13 | 26598 | 26617 | 519 |
| 771921 | N/A | N/A | TCCTCCCTTTAAAGGGAAGG | 14 | 26716 | 26735 | 520 |
| 771922 | N/A | N/A | AAATTCCTTTAAGGTGTTGC | 29 | 26774 | 26793 | 521 |
| 771928 | N/A | N/A | CCCCATTGCCACTACAGAGA | 0 | 27288 | 27307 | 522 |
| 771929 | N/A | N/A | CTTTCCAGCAAAACCATTCG | 0 | 27380 | 27399 | 523 |
| 771930 | N/A | N/A | CCAGCCCAGAAAAACTGCAA | 26 | 27601 | 27620 | 524 |
| 771936 | N/A | N/A | TGTTTCTGTGTGCACATACG | 36 | 28358 | 28377 | 525 |
| 771937 | N/A | N/A | TCCAGTGCTTGTGCATGTGC | 52 | 28429 | 28448 | 526 |
| 771938 | N/A | N/A | CCTTCCCAAATGCCTGCCCC | 29 | 28565 | 28584 | 527 |
| 771944 | N/A | N/A | GGTAATTTTCCTCAACAGGC | 8 | 29276 | 29295 | 528 |
| 771945 | N/A | N/A | TTATGTGTCTCAAATAGATG | 0 | 29486 | 29505 | 529 |
| 771946 | N/A | N/A | GGGCTACCTTAACAAAGCTT | 47 | 29526 | 29545 | 530 |
| 771952 | N/A | N/A | TCTTCTCTGCAGAGCACAGA | 0 | 29990 | 30009 | 531 |
| 771953 | N/A | N/A | TCACCAGCTCATCTCTCAGG | 42 | 30190 | 30209 | 532 |
| 771954 | N/A | N/A | CTAGAATGAAGACACCCGCC | 0 | 30226 | 30245 | 533 |
| 771465 | 1123 | 1142 | ATCCAGAGAGGGCTCCTGGA | 0 | 30390 | 30409 | 534 |
| 771466 | 1128 | 1147 | AAGATATCCAGAGAGGGCTC | 38 | 30395 | 30414 | 535 |
| 771467 | 1133 | 1152 | CATAGAAGATATCCAGAGAG | 11 | 30400 | 30419 | 536 |
| 771473 | 1223 | 1242 | AGCCGATTTTGCTCCGCACC | 9 | 30490 | 30509 | 537 |
| 771474 | 1225 | 1244 | GCAGCCGATTTTGCTCCGCA | 56 | 30492 | 30511 | 538 |
| 771475 | 1240 | 1259 | CGTCAGCTGGATGCCGCAGC | 26 | 30507 | 30526 | 539 |
| 771481 | 1400 | 1419 | GCAGGCTGTACGCCTTCTCG | 0 | 30667 | 30686 | 540 |
| 771482 | 1405 | 1424 | CCGCTGCAGGCTGTACGCCT | 38 | 30672 | 30691 | 541 |
| 771483 | 1436 | 1455 | ACGGCTGCTGCATAAACTCG | 22 | 30703 | 30722 | 542 |
| 771489 | 1466 | 1485 | CAAAGCTGATCTGCACGGTA | 27 | 30733 | 30752 | 543 |
| 771490 | 1471 | 1490 | CTTCACAAAGCTGATCTGCA | 44 | 30738 | 30757 | 544 |
| 771491 | 1481 | 1500 | GGCCCCAGCCCTTCACAAAG | 39 | 30748 | 30767 | 545 |
| 771497 | 1537 | 1556 | GAAGATGACCTCTAGCCAGC | 0 | 30804 | 30823 | 546 |
| 771498 | 1542 | 1561 | CTGTTGAAGATGACCTCTAG | 48 | 30809 | 30828 | 547 |
| 771499 | 1550 | 1569 | GCTACCGGCTGTTGAAGATG | 1 | 30817 | 30836 | 548 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771505 | 1581 | 1600 | CTCAGCTCACGCTCTGTCCC | 0 | 30848 | 30867 | 549 |
| 771506 | 1582 | 1601 | GCTCAGCTCACGCTCTGTCC | 53 | 30849 | 30868 | 550 |
| 483664 | 1583 | 1602 | TGCTCAGCTCACGCTCTGTC | 36 | 30850 | 30869 | 551 |
| 771512 | 1602 | 1621 | AGTAGTTTGAAGTGTGGCCT | 0 | 30869 | 30888 | 552 |
| 771513 | 1607 | 1626 | AGCAAAGTAGTTTGAAGTGT | 34 | 30874 | 30893 | 553 |
| 771514 | 1612 | 1631 | TTAGCAGCAAAGTAGTTTGA | 19 | 30879 | 30898 | 554 |
| 771520 | 1641 | 1660 | ATGAAAAGCAAGCACTCAGG | 12 | 30908 | 30927 | 555 |
| 771521 | 1642 | 1661 | CATGAAAAGCAAGCACTCAG | 33 | 30909 | 30928 | 556 |
| 771522 | 1643 | 1662 | GCATGAAAAGCAAGCACTCA | 29 | 30910 | 30929 | 557 |
| 771528 | 1652 | 1671 | AAAGAGTTTGCATGAAAAGC | 4 | 30919 | 30938 | 558 |
| 771529 | 1657 | 1676 | CGACCAAAGAGTTTGCATGA | 0 | 30924 | 30943 | 559 |
| 771530 | 1662 | 1681 | AAAAACGACCAAAGAGTTTG | 16 | 30929 | 30948 | 560 |
| 771536 | 1723 | 1742 | AGCGAAACAAAACAGAACAC | 0 | 30990 | 31009 | 561 |
| 771537 | 1728 | 1747 | CAAAGAGCGAAACAAAACAG | 16 | 30995 | 31014 | 562 |
| 771538 | 1733 | 1752 | TTTCTCAAAGAGCGAAACAA | 24 | 31000 | 31019 | 563 |
| 771544 | 1763 | 1782 | AAAACCCCCAACAATTCTTT | 0 | 31030 | 31049 | 564 |
| 771545 | 1768 | 1787 | CCAAAAAAACCCCCAACAAT | 21 | 31035 | 31054 | 565 |
| 771546 | 1783 | 1802 | TACCTGCCCCTTCTTCCAAA | 26 | 31050 | 31069 | 566 |
| 771552 | 1830 | 1849 | CTTGGATTTCTGCTTCCCCT | 28 | 31097 | 31116 | 567 |
| 771553 | 1835 | 1854 | TGGTGCTTGGATTTCTGCTT | 38 | 31102 | 31121 | 568 |
| 771554 | 1840 | 1859 | TTTGGTGGTGCTTGGATTTC | 20 | 31107 | 31126 | 569 |
| 771560 | 1881 | 1900 | CTGACAAGTGAAATGATGAC | 0 | 31148 | 31167 | 570 |
| 771561 | 1886 | 1905 | CACTCCTGACAAGTGAAATG | 30 | 31153 | 31172 | 571 |
| 771562 | 1891 | 1910 | ACACACACTCCTGACAAGTG | 30 | 31158 | 31177 | 572 |
| 771568 | 2003 | 2022 | CTGCAAACCTCTCTGCTGGG | 17 | 31270 | 31289 | 573 |
| 771569 | 2006 | 2025 | GGACTGCAAACCTCTCTGCT | 30 | 31273 | 31292 | 574 |
| 771570 | 2008 | 2027 | TGGGACTGCAAACCTCTCTG | 60 | 31275 | 31294 | 575 |
| 771576 | 2027 | 2046 | GGGCAGGAGAGACACCGCTT | 28 | 31294 | 31313 | 576 |
| 771577 | 2055 | 2074 | TGCCTCTGCCCCACTGAGCG | 21 | 31322 | 31341 | 577 |
| 771578 | 2056 | 2075 | CTGCCTCTGCCCCACTGAGC | 50 | 31323 | 31342 | 578 |
| 771584 | 2107 | 2126 | AGCCGTGCTCCTGGCAGCTG | 7 | 31374 | 31393 | 579 |
| 771585 | 2108 | 2127 | GAGCCGTGCTCCTGGCAGCT | 49 | 31375 | 31394 | 580 |
| 771586 | 2155 | 2174 | CCTTGATGAGGGAGAGGAGG | 48 | 31422 | 31441 | 581 |
| 771592 | 2185 | 2204 | CTGCTCAGAAGCCTGTGGAC | 0 | 31452 | 31471 | 582 |
| 771593 | 2187 | 2206 | CGCTGCTCAGAAGCCTGTGG | 41 | 31454 | 31473 | 583 |
| 771594 | 2202 | 2221 | GGCCACTAGCAGGCTCGCTG | 37 | 31469 | 31488 | 584 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771600 | 2284 | 2303 | TGGCCAAAAAGAAAGACGC | 0 | 31551 | 31570 | 585 |
| 771601 | 2286 | 2305 | GATGGCCAAAAAGAAAGAC | 13 | 31553 | 31572 | 586 |
| 771602 | 2301 | 2320 | GGAGATCCAGGAGCAGATGG | 39 | 31568 | 31587 | 587 |
| 771608 | 2359 | 2378 | CTGGGTGAGCAATACTGTGA | 34 | 31626 | 31645 | 588 |
| 771609 | 2402 | 2421 | ATGTCACCAGGGCAGGCAGG | 47 | 31669 | 31688 | 589 |
| 771610 | 2407 | 2426 | ACCTGATGTCACCAGGGCAG | 52 | 31674 | 31693 | 590 |
| 771616 | 2437 | 2456 | TGCTGAGCTGGTTTTCTAAG | 0 | 31704 | 31723 | 591 |
| 771617 | 2440 | 2459 | CAGTGCTGAGCTGGTTTTCT | 10 | 31707 | 31726 | 592 |
| 771618 | 2455 | 2474 | CAGGATGGGAGCAGGCAGTG | 30 | 31722 | 31741 | 593 |
| 771624 | 2463 | 2482 | TTAACACACAGGATGGGAGC | 0 | 31730 | 31749 | 594 |
| 771625 | 2465 | 2484 | GCTTAACACACAGGATGGGA | 48 | 31732 | 31751 | 595 |
| 771626 | 2470 | 2489 | GCAGAGCTTAACACACAGGA | 35 | 31737 | 31756 | 596 |
| 771632 | 2541 | 2560 | AATCCTTCTTGGAGGGAAGG | 31 | 31808 | 31827 | 597 |
| 771633 | 2546 | 2565 | GACCAAATCCTTCTTGGAGG | 40 | 31813 | 31832 | 598 |
| 771634 | 2551 | 2570 | TGACGGACCAAATCCTTCTT | 53 | 31818 | 31837 | 599 |
| 771640 | 2581 | 2600 | GGTGTCAGCCTAGGATGGTA | 0 | 31848 | 31867 | 600 |
| 771641 | 2586 | 2605 | AGTTAGGTGTCAGCCTAGGA | 71 | 31853 | 31872 | 601 |
| 771642 | 2591 | 2610 | AGAAGAGTTAGGTGTCAGCC | 36 | 31858 | 31877 | 602 |
| 771648 | 2623 | 2642 | CATACGAGTGTATGAGTTGT | 0 | 31890 | 31909 | 603 |
| 771649 | 2629 | 2648 | AAGTATCATACGAGTGTATG | 0 | 31896 | 31915 | 604 |
| 771650 | 2630 | 2649 | GAAGTATCATACGAGTGTAT | 24 | 31897 | 31916 | 605 |
| 771656 | 2670 | 2689 | GTTAAAGTCTAAACATGCTC | 0 | 31937 | 31956 | 606 |
| 771657 | 2675 | 2694 | CTTATGTTAAAGTCTAAACA | 6 | 31942 | 31961 | 607 |
| 771658 | 2680 | 2699 | AATAGCTTATGTTAAAGTCT | 33 | 31947 | 31966 | 608 |
| 771664 | 2734 | 2753 | TAAATTTCCAATGAGAATGC | 5 | 32001 | 32020 | 609 |
| 771665 | 2739 | 2758 | AATGCTAAATTTCCAATGAG | 24 | 32006 | 32025 | 610 |
| 771666 | 2744 | 2763 | ACTACAATGCTAAATTTCCA | 39 | 32011 | 32030 | 611 |
| 771672 | 2774 | 2793 | TTTTTTCAGGAGTCCTTTCT | 2 | 32041 | 32060 | 612 |
| 771673 | 2779 | 2798 | AGGTTTTTTTCAGGAGTCC | 44 | 32046 | 32065 | 613 |
| 771674 | 2788 | 2807 | ATAAATCTCAGGTTTTTTTT | 0 | 32055 | 32074 | 614 |
| 771680 | 2935 | 2954 | ATTTATATTAAAGCAAAGTG | 0 | 32202 | 32221 | 615 |
| 771681 | 2940 | 2959 | TTTGCATTTATATTAAAGCA | 0 | 32207 | 32226 | 616 |
| 771682 | 2945 | 2964 | TGTTATTTGCATTTATATTA | 18 | 32212 | 32231 | 617 |
| 771688 | 3047 | 3066 | CGTTTAATGGAACATAAACT | 0 | 32314 | 32333 | 618 |
| 771689 | 3065 | 3084 | AGTGTACATTTTAAAAATCG | 30 | 32332 | 32351 | 619 |

TABLE 4-continued

Inhibition of SMAD7 mRNA expression by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 582468 | N/A | N/A | GCCAATATCATAACCCAAGC | 0 | N/A | N/A | 392 |
| 771451 | 886 | 905 | AGACTCTAGTTCGCAGAGTC | 15 | N/A | N/A | 620 |

TABLE 5

Inhibition of SMAD7 mRNA by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 278478 | 220 | 239 | ACATGACCTCCGCACACCAT | 54 | 1715 | 1734 | 399 |
| 483663 | 799 | 818 | CAGCCTCTTGACTTCCGAGG | 35 | 2294 | 2313 | 22 |
| 771347 | N/A | N/A | TGGGCCACTGGTGTTCGACG | 32 | 2892 | 2911 | 426 |
| 771355 | N/A | N/A | CAGTTCGGCCTTCCATCCAA | 13 | 2958 | 2977 | 429 |
| 771363 | N/A | N/A | TCAGGCTTCACTGCCCATCG | 35 | 9482 | 9501 | 449 |
| 771371 | N/A | N/A | CCACACATTCCAAAAGGCTG | 14 | 9537 | 9556 | 626 |
| 771379 | N/A | N/A | GATCCATCTTTAAGCACGCT | 21 | 9578 | 9597 | 455 |
| 771387 | N/A | N/A | AGCATCTGGACAGTCTGCTG | 59 | 9649 | 9668 | 458 |
| 771395 | 31 | 50 | GCGCTCCGGCTGCCCCACCC | 34 | 1526 | 1545 | 396 |
| 771409 | 356 | 375 | CCCCTGCGCCCTCCTCCTCG | 33 | 1851 | 1870 | 402 |
| 771417 | 421 | 440 | ACCGGCCCCATGCGCTCGGC | 24 | 1916 | 1935 | 405 |
| 771425 | 461 | 480 | CCTTGCCCAGGCAGCATCCA | 15 | 1956 | 1975 | 408 |
| 771433 | 582 | 601 | TCCTTCAGTTTCTTGAGCAC | 28 | 2077 | 2096 | 411 |
| 771441 | 721 | 740 | CGAGGGCGGCTGCGCAGGCT | 60 | 2216 | 2235 | 414 |
| 771449 | 876 | 895 | TCGCAGAGTCGGCTAAGGTG | 4 | 2371 | 2390 | 417 |
| 771696 | N/A | N/A | CTCTCCCAGGAGGGTATGCA | 0 | 2499 2521 | 2518 2540 | 420 |
| 771704 | N/A | N/A | CAGGAGGGTATGCACACTCT | 55 | 2515 2537 | 2534 2556 | 423 |
| 771465 | 1123 | 1142 | ATCCAGAGAGGGCTCCTGGA | 16 | 30390 | 30409 | 534 |
| 771473 | 1223 | 1242 | AGCCGATTTTGCTCCGCACC | 37 | 30490 | 30509 | 537 |
| 771481 | 1400 | 1419 | GCAGGCTGTACGCCTTCTCG | 26 | 30667 | 30686 | 540 |
| 771489 | 1466 | 1485 | CAAAGCTGATCTGCACGGTA | 34 | 30733 | 30752 | 543 |
| 771497 | 1537 | 1556 | GAAGATGACCTCTAGCCAGC | 25 | 30804 | 30823 | 546 |
| 771505 | 1581 | 1600 | CTCAGCTCACGCTCTGTCCC | 29 | 30848 | 30867 | 549 |
| 771512 | 1602 | 1621 | AGTAGTTTGAAGTGTGGCCT | 34 | 30869 | 30888 | 552 |
| 771520 | 1641 | 1660 | ATGAAAAGCAAGCACTCAGG | 37 | 30908 | 30927 | 555 |
| 771528 | 1652 | 1671 | AAAGAGTTTGCATGAAAAGC | 12 | 30919 | 30938 | 558 |

TABLE 5-continued

Inhibition of SMAD7 mRNA by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771536 | 1723 | 1742 | AGCGAAACAAAACAGAACAC | 25 | 30990 | 31009 | 561 |
| 771544 | 1763 | 1782 | AAAACCCCCAACAATTCTTT | 16 | 31030 | 31049 | 564 |
| 771552 | 1830 | 1849 | CTTGGATTTCTGCTTCCCCT | 53 | 31097 | 31116 | 567 |
| 771560 | 1881 | 1900 | CTGACAAGTGAAATGATGAC | 0 | 31148 | 31167 | 570 |
| 771568 | 2003 | 2022 | CTGCAAACCTCTCTGCTGGG | 26 | 31270 | 31289 | 573 |
| 771576 | 2027 | 2046 | GGGCAGGAGAGACACCGCTT | 64 | 31294 | 31313 | 576 |
| 771584 | 2107 | 2126 | AGCCGTGCTCCTGGCAGCTG | 26 | 31374 | 31393 | 579 |
| 771592 | 2185 | 2204 | CTGCTCAGAAGCCTGTGGAC | 16 | 31452 | 31471 | 582 |
| 771600 | 2284 | 2303 | TGGCCAAAAAGAAAGACGC | 11 | 31551 | 31570 | 585 |
| 771608 | 2359 | 2378 | CTGGGTGAGCAATACTGTGA | 45 | 31626 | 31645 | 588 |
| 771616 | 2437 | 2456 | TGCTGAGCTGGTTTTCTAAG | 33 | 31704 | 31723 | 591 |
| 771624 | 2463 | 2482 | TTAACACACAGGATGGGAGC | 27 | 31730 | 31749 | 594 |
| 771632 | 2541 | 2560 | AATCCTTCTTGGAGGGAAGG | 54 | 31808 | 31827 | 597 |
| 771640 | 2581 | 2600 | GGTGTCAGCCTAGGATGGTA | 35 | 31848 | 31867 | 600 |
| 771648 | 2623 | 2642 | CATACGAGTGTATGAGTTGT | 17 | 31890 | 31909 | 603 |
| 771656 | 2670 | 2689 | GTTAAAGTCTAAACATGCTC | 35 | 31937 | 31956 | 606 |
| 771664 | 2734 | 2753 | TAAATTTCCAATGAGAATGC | 25 | 32001 | 32020 | 609 |
| 771672 | 2774 | 2793 | TTTTTTCAGGAGTCCTTTCT | 30 | 32041 | 32060 | 612 |
| 771680 | 2935 | 2954 | ATTTATATTAAAGCAAAGTG | 0 | 32202 | 32221 | 615 |
| 771688 | 3047 | 3066 | CGTTTAATGGAACATAAACT | 13 | 32314 | 32333 | 618 |
| 771712 | N/A | N/A | ATTCTTTTAGCCCAACTGTT | 27 | 3676 | 3695 | 430 |
| 771720 | N/A | N/A | CAGGCAGAGCTATGCTTCAA | 37 | 4396 | 4415 | 433 |
| 771728 | N/A | N/A | AACTTTTCTCCCCCTTGGAA | 7 | 5537 | 5556 | 436 |
| 771736 | N/A | N/A | TGCCAGATCTCAGGTCAAGA | 34 | 6539 | 6558 | 439 |
| 771744 | N/A | N/A | GGCTATTCCCAAGAGTCCAG | 40 | 7595 | 7614 | 442 |
| 771752 | N/A | N/A | AATGTCCCTGTGGGTTTCCA | 3 | 8497 | 8516 | 445 |
| 771760 | N/A | N/A | ATCTTACCTGAAAGCCCCCC | 25 | 9714 | 9733 | 459 |
| 771768 | N/A | N/A | GTATGCTTGGGATCTGTCTT | 24 | 10143 | 10162 | 462 |
| 771776 | N/A | N/A | CTCAGCAAGCTCAGTTCCTG | 54 | 10811 | 10830 | 465 |
| 771784 | N/A | N/A | TAAATCAAGAGCTGAAATTC | 1 | 11958 | 11977 | 468 |
| 771792 | N/A | N/A | AGCACACCCCACCCCCACCT | 33 | 12632 | 12651 | 471 |
| 771800 | N/A | N/A | GACAGCAGACAGGCAAAATG | 32 | 13523 | 13542 | 474 |
| 771808 | N/A | N/A | CCCCAAAGTCCACGCTCATG | 54 | 14368 | 14387 | 477 |
| 771816 | N/A | N/A | ATCCAACTACTCAGAGGCTG | 28 | 15227 | 15246 | 480 |
| 771824 | N/A | N/A | TTCTACTAGAAAAAAATTAG | 3 | 16278 | 16297 | 483 |
| 771832 | N/A | N/A | ACCTTTCACGAACCACTTTT | 31 | 17364 | 17383 | 486 |

TABLE 5-continued

Inhibition of SMAD7 mRNA by 5-10-5 MOE gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 771840 | N/A | N/A | AGATGCTTCTAGGTGAACCA | 30 | 18033 | 18052 | 489 |
| 771848 | N/A | N/A | CCACACAACCAAAGCAGAAG | 47 | 19011 | 19030 | 492 |
| 771856 | N/A | N/A | CTGAAAGAAAGTCCCGACTT | 35 | 19740 | 19759 | 495 |
| 771864 | N/A | N/A | AGACAAAGATCACAGATCAC | 27 | 20528 | 20547 | 498 |
| 771872 | N/A | N/A | TCCCCCACCGCGCAGGGACA | 11 | 21590 | 21609 | 501 |
| 771880 | N/A | N/A | TCCCTGGTTTTGCAGGTGGT | 41 | 22497 | 22516 | 504 |
| 771888 | N/A | N/A | TCGCCATGGAGAATGTAATT | 21 | 23351 | 23370 | 507 |
| 771896 | N/A | N/A | GGGCCCCCTTCTGCCTTCAT | 17 | 23956 | 23975 | 510 |
| 771904 | N/A | N/A | CCCAACCCATCTCCACCACC | 0 | 24966 | 24985 | 513 |
| 771912 | N/A | N/A | ATATTCCTCTGCCAAAGTCC | 44 | 25710 | 25729 | 516 |
| 771920 | N/A | N/A | TTATTTAATTACCCTGCTCA | 33 | 26598 | 26617 | 519 |
| 771928 | N/A | N/A | CCCCATTGCCACTACAGAGA | 27 | 27288 | 27307 | 522 |
| 771936 | N/A | N/A | TGTTTCTGTGTGCACATACG | 32 | 28358 | 28377 | 525 |
| 771944 | N/A | N/A | GGTAATTTTCCTCAACAGGC | 50 | 29276 | 29295 | 528 |
| 771952 | N/A | N/A | TCTTCTCTGCAGAGCACAGA | 26 | 29990 | 30009 | 531 |

TABLE 6

Inhibition of SMAD7 mRNA expression by 5-10-5 MOE gapmers targeting SEQ ID NO: 3 and 4

| IONIS NO. | SEQ ID: 3 Start Site | SEQ ID: 3 Stop Site | Sequence | % Inhibition | SEQ ID: 4 Start Site | SEQ ID 4: Stop Site | SEQ ID NO. |
|---|---|---|---|---|---|---|---|
| 771342 | 936 | 955 | TCAGTTGGTTTGAGAAAATC | 35 | N/A | N/A | 621 |
| 771343 | 941 | 960 | GACAGTCAGTTGGTTTGAGA | 0 | N/A | N/A | 622 |
| 771344 | 946 | 965 | ATCTGGACAGTCAGTTGGTT | 17 | N/A | N/A | 623 |
| 771345 | 951 | 970 | ACAGCATCTGGACAGTCAGT | 54 | N/A | N/A | 624 |
| 771356 | N/A | N/A | TCCAGTTCGGCCTTCCATCC | 40 | 87 | 102 | 625 |

Example 2: Antisense Inhibition of Human SMAD7 mRNA Expression in Hep3B Cells by 3-10-3 cEt Gapmers Antisense oligonucleotides were designed to target human SMAD7 mRNA and were tested for their effects on SMAD7 mRNA expression in vitro. The antisense oligonucleotides were tested in a series of experiments that had similar culture conditions, as described below. The results for each experiment are presented in separate tables shown below. ION 771576, described in the studies above and which is a 5-10-5 MOE gapmer, was also included in these assays. Cultured Hep3B cells at a density of 20,000 cells per well were transfected using electroporation with 10,000 nM antisense oligonucleotide. After a treatment period of approximately 24 hours, RNA was isolated from the cells and SMAD7 mRNA levels were measured by quantitative real-time PCR. Primer probe set RTS5062 was used to measure human SMAD7 mRNA levels. SMAD7 mRNA levels were adjusted according to total RNA content, as measured by RIBOGREEN®. Results are presented as percent inhibition of SMAD7 mRNA expression, relative to untreated control cells.

The newly designed chimeric antisense oligonucleotides in the Tables below were designed as 3-10-3 cEt gapmers. The gapmers are 16 nucleosides in length, wherein the central gap segment comprises often 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO: 1 or SEQ ID NO: 2. 'n/a' indicates that the antisense oligonucleotide does not target that particular gene sequence with 100% complementarity. Some of the oligonucleotides presented were complementary to SMAD7 mRNA sequences RefSeqNo. NM_001190821.1 (designated herein as SEQ ID NO: 3) or RefSeqNo. NM_001190822.1 (designated herein as SEQ ID NO: 4), and are presented in a separate table shown below.

TABLE 7

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798654 | 2 | 17 | CCCTGCGCGGCTCTCC | 23 | 1497 | 1512 | 626 |
| 798655 | 10 | 25 | GGCCCGCGCCCTGCGC | 21 | 1505 | 1520 | 627 |
| 798656 | 13 | 28 | CGCGGCCCGCGCCCTG | 10 | 1508 | 1523 | 628 |
| 798657 | 16 | 31 | CCGCGCGGCCCGCGCC | 0 | 1511 | 1526 | 629 |
| 798658 | 19 | 34 | ACCCCGCGCGGCCCGC | 71 | 1514 | 1529 | 630 |
| 798659 | 22 | 37 | CCCACCCCGCGCGGCC | 58 | 1517 | 1532 | 631 |
| 798660 | 25 | 40 | TGCCCACCCCGCGCG | 38 | 1520 | 1535 | 632 |
| 798661 | 28 | 43 | GGCTGCCCCACCCCGC | 52 | 1523 | 1538 | 633 |
| 798662 | 33 | 48 | GCTCCGGCTGCCCCAC | 62 | 1528 | 1543 | 634 |
| 798663 | 36 | 51 | TGCGCTCCGGCTGCCC | 41 | 1531 | 1546 | 635 |
| 798672 | 141 | 156 | GGCAGGAGCGGCGGCG | 6 | 1636 | 1651 | 636 |
| 790461 | 144 | 159 | CCGGGCAGGAGCGGCG | 42 | 1639 | 1654 | 637 |
| 798673 | 147 | 162 | GGCCCGGGCAGGAGCG | 15 | 1642 | 1657 | 638 |
| 798674 | 170 | 185 | CAGGCGACAGCAGCAG | 39 | 1665 | 1680 | 639 |
| 790462 | 173 | 188 | GCGCAGGCGACAGCAG | 43 | 1668 | 1683 | 640 |
| 798675 | 176 | 191 | CAGGCGCAGGCGACAG | 51 | 1671 | 1686 | 641 |
| 772532 | 179 | 194 | CAGCAGGCGCAGGCGA | 21 | 1674 | 1689 | 642 |
| 772533 | 205 | 220 | TGAAGAAGTCGGGCGC | 31 | 1700 | 1715 | 643 |
| 798676 | 208 | 223 | CCATGAAGAAGTCGGG | 21 | 1703 | 1718 | 644 |
| 798677 | 211 | 226 | ACACCATGAAGAAGTC | 36 | 1706 | 1721 | 645 |
| 790468 | 259 | 274 | GCGAGGAGAAAAGTCG | 0 | 1754 | 1769 | 646 |
| 798685 | 262 | 277 | GAGGCGAGGAGAAAAG | 58 | 1757 | 1772 | 647 |
| 798686 | 265 | 280 | GAGGAGGCGAGGAGAA | 59 | 1760 | 1775 | 648 |
| 798687 | 268 | 283 | GGCGAGGAGGCGAGGA | 64 | 1763 | 1778 | 649 |
| 798688 | 283 | 298 | GTCCTGAACATGCGGG | 68 | 1778 | 1793 | 650 |
| 772543 | 303 | 318 | GGACGAGCGCAGATCG | 58 | 1798 | 1813 | 651 |
| 798689 | 306 | 321 | GCCGGACGAGCGCAGA | 33 | 1801 | 1816 | 652 |
| 798690 | 321 | 336 | GGCTCCTCCAGAGACG | 29 | 1816 | 1831 | 653 |
| 798691 | 326 | 341 | CGCACGGCTCCTCCAG | 42 | 1821 | 1836 | 654 |
| 798692 | 329 | 344 | GGGCGCACGGCTCCTC | 48 | 1824 | 1839 | 655 |
| 798703 | 404 | 419 | GTCCGTCGCCCCTTCT | 68 | 1899 | 1914 | 656 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798704 | 406 | 421 | CTGTCCGTCGCCCCTT | 61 | 1901 | 1916 | 657 |
| 798705 | 408 | 423 | GGCTGTCCGTCGCCCC | 41 | 1903 | 1918 | 658 |
| 798706 | 409 | 424 | CGGCTGTCCGTCGCCC | 1 | 1904 | 1919 | 659 |
| 798707 | 412 | 427 | GCTCGGCTGTCCGTCG | 74 | 1907 | 1922 | 660 |
| 798708 | 413 | 428 | CGCTCGGCTGTCCGTC | 45 | 1908 | 1923 | 661 |
| 798709 | 415 | 430 | TGCGCTCGGCTGTCCG | 2 | 1910 | 1925 | 662 |
| 798710 | 420 | 435 | CCCCATGCGCTCGGCT | 54 | 1915 | 1930 | 663 |
| 798711 | 423 | 438 | CGGCCCCATGCGCTCG | 59 | 1918 | 1933 | 664 |
| 798712 | 428 | 443 | GCCACCGGCCCCATGC | 6 | 1923 | 1938 | 665 |
| 798723 | 467 | 482 | CGCCTTGCCCAGGCAG | 0 | 1962 | 1977 | 666 |
| 798724 | 470 | 485 | CACCGCCTTGCCCAGG | 19 | 1965 | 1980 | 667 |
| 798725 | 473 | 488 | TCGCACCGCCTTGCCC | 29 | 1968 | 1983 | 668 |
| 798726 | 477 | 492 | CACCTCGCACCGCCTT | 7 | 1972 | 1987 | 669 |
| 798727 | 480 | 495 | TGGCACCTCGCACCGC | 51 | 1975 | 1990 | 670 |
| 798728 | 483 | 498 | CTTTGGCACCTCGCAC | 41 | 1978 | 1993 | 671 |
| 798729 | 486 | 501 | GACCTTTGGCACCTCG | 51 | 1981 | 1996 | 672 |
| 798730 | 489 | 504 | GGTGACCTTTGGCACC | 0 | 1984 | 1999 | 673 |
| 798731 | 492 | 507 | GGTGGTGACCTTTGGC | 43 | 1987 | 2002 | 674 |
| 798732 | 496 | 511 | GGATGGTGGTGACCTT | 51 | 1991 | 2006 | 675 |
| 798742 | 587 | 602 | CTCCTTCAGTTTCTTG | 30 | 2082 | 2097 | 676 |
| 798743 | 592 | 607 | TGCCGCTCCTTCAGTT | 19 | 2087 | 2102 | 677 |
| 798744 | 595 | 610 | AGCTGCCGCTCCTTCA | 12 | 2090 | 2105 | 678 |
| 798745 | 603 | 618 | GCAGCTCCAGCTGCCG | 0 | 2098 | 2113 | 679 |
| 798746 | 610 | 625 | TGGAGCAGCAGCTCCA | 30 | 2105 | 2120 | 680 |
| 798747 | 615 | 630 | CGGCCTGGAGCAGCAG | 14 | 2110 | 2125 | 681 |
| 798748 | 620 | 635 | CTCCACGGCCTGGAGC | 58 | 2115 | 2130 | 682 |
| 798749 | 623 | 638 | GGACTCCACGGCCTGG | 63 | 2118 | 2133 | 683 |
| 772555 | 649 | 664 | AGGCACGCGGTGCGCG | 23 | 2144 | 2159 | 684 |
| 798750 | 652 | 667 | AGGAGGCACGCGGTGC | 54 | 2147 | 2162 | 685 |
| 798758 | 717 | 732 | GCTGCGCAGGCTGCGC | 0 | 2212 | 2227 | 686 |
| 798759 | 721 | 736 | GGCGGCTGCGCAGGCT | 40 | 2216 | 2231 | 687 |
| 798760 | 724 | 739 | GAGGGCGGCTGCGCAG | 47 | 2219 | 2234 | 688 |
| 798761 | 727 | 742 | GACGAGGGCGGCTGCG | 39 | 2222 | 2237 | 689 |
| 798762 | 730 | 745 | TAGGACGAGGGCGGCT | 56 | 2225 | 2240 | 690 |
| 798763 | 733 | 748 | GAGTAGGACGAGGGCG | 53 | 2228 | 2243 | 691 |
| 772559 | 736 | 751 | AGCGAGTAGGACGAGG | 14 | 2231 | 2246 | 692 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 772560 | 754 | 769 | TTGCACAGCAGGAGGG | 66 | 2249 | 2264 | 693 |
| 798764 | 757 | 772 | ACTTTGCACAGCAGGA | 69 | 2252 | 2267 | 694 |
| 798765 | 760 | 775 | AACACTTTGCACAGCA | 63 | 2255 | 2270 | 695 |
| 798773 | 795 | 810 | TGACTTCCGAGGAATG | 40 | 2290 | 2305 | 696 |
| 798774 | 796 | 811 | TTGACTTCCGAGGAAT | 12 | 2291 | 2306 | 697 |
| 790489 | 799 | 814 | CTCTTGACTTCCGAGG | 0 | 2294 | 2309 | 698 |
| 798775 | 800 | 815 | CCTCTTGACTTCCGAG | 0 | 2295 | 2310 | 699 |
| 772568 | 802 | 817 | AGCCTCTTGACTTCCG | 82 | 2297 | 2312 | 700 |
| 798776 | 806 | 821 | ACACAGCCTCTTGACT | 34 | 2301 | 2316 | 701 |
| 798777 | 809 | 824 | GCAACACAGCCTCTTG | 20 | 2304 | 2319 | 702 |
| 798778 | 813 | 828 | CACAGCAACACAGCCT | 64 | 2308 | 2323 | 703 |
| 798779 | 816 | 831 | ATTCACAGCAACACAG | 31 | 2311 | 2326 | 704 |
| 798780 | 819 | 834 | AAGATTCACAGCAACA | 58 | 2314 | 2329 | 705 |
| 798785 | 885 | 900 | CTAGTTCGCAGAGTCG | 0 | 2380 | 2395 | 706 |
| 799322 | N/A | N/A | GGAGGGTATGCACACT | 83 | 2495 2517 2539 | 2510 2532 2554 | 707 |
| 799323 | N/A | N/A | CCAGGAGGGTATGCAC | 60 | 2498 2520 2542 | 2513 2535 2557 | 708 |
| 799324 | N/A | N/A | TCCCAGGAGGGTATGC | 6 | 2500 2522 2544 | 2515 2537 2559 | 709 |
| 799325 | N/A | N/A | TCTCCCAGGAGGGTAT | 2 | 2502 2524 | 2517 2539 | 710 |
| 799326 | N/A | N/A | ACACTCTCCCAGGAGG | 31 | 2506 2528 | 2521 2543 | 711 |
| 799327 | N/A | N/A | GCACACTCTCCCAGGA | 52 | 2508 2530 | 2523 2545 | 712 |
| 799338 | N/A | N/A | TTATAGCACGCCTCTC | 0 | 2828 | 2843 | 713 |
| 799242 | N/A | N/A | CGTGATTCTCCGTATT | 0 | 2878 | 2893 | 714 |
| 799243 | N/A | N/A | CCACTGGTGTTCGACG | 19 | 2892 | 2907 | 715 |
| 799244 | N/A | N/A | GGGCCACTGGTGTTCG | 8 | 2895 | 2910 | 716 |
| 799245 | N/A | N/A | GTATCTGGGCCACTGG | 18 | 2901 | 2916 | 717 |
| 799246 | N/A | N/A | ACAGTATCTGGGCCAC | 74 | 2904 | 2919 | 718 |
| 799247 | N/A | N/A | ACGACAGTATCTGGGC | 61 | 2907 | 2922 | 719 |
| 799248 | N/A | N/A | GCCACGACAGTATCTG | 40 | 2910 | 2925 | 720 |
| 799249 | N/A | N/A | GCGGCCACGACAGTAT | 26 | 2913 | 2928 | 721 |
| 799250 | N/A | N/A | TGCGCGGCCACGACAG | 21 | 2916 | 2931 | 722 |
| 799251 | N/A | N/A | AGGTGCGCGGCCACGA | 37 | 2919 | 2934 | 723 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799262 | N/A | N/A | CTCTTTGCCCCAAAAC | 0 | 2940 | 2955 | 724 |
| 799263 | N/A | N/A | TCCAACTCTCTTTGCC | 0 | 2947 | 2962 | 725 |
| 799264 | N/A | N/A | CCATCCAACTCTCTTT | 16 | 2950 | 2965 | 726 |
| 799265 | N/A | N/A | CTTCCATCCAACTCTC | 3 | 2953 | 2968 | 727 |
| 799266 | N/A | N/A | GGCCTTCCATCCAACT | 37 | 2956 | 2971 | 728 |
| 799267 | N/A | N/A | GTTCGGCCTTCCATCC | 62 | 2960 | 2975 | 729 |
| 799339 | N/A | N/A | GATACCCAGTTCGGCC | 18 | 2968 | 2983 | 730 |
| 799340 | N/A | N/A | AGATACCCAGTTCGGC | 0 | 2969 | 2984 | 731 |
| 799341 | N/A | N/A | GAAGGAAAAAGTAGGG | 8 | 3050 | 3065 | 732 |
| 799342 | N/A | N/A | CTTATCTGTGCGGAAG | 44 | 3066 | 3081 | 733 |
| 799343 | N/A | N/A | ACTAATCTACAGACTT | 53 | 3079 | 3094 | 734 |
| 799344 | N/A | N/A | CCCACTAATCTACAGA | 34 | 3082 | 3097 | 735 |
| 799345 | N/A | N/A | CGAGAAGCCCAGGCCC | 20 | 3139 | 3154 | 736 |
| 799346 | N/A | N/A | TCTCAGCCGAGAAGCC | 26 | 3146 | 3161 | 737 |
| 799347 | N/A | N/A | AAGGAGTTTCAGGGTC | 59 | 3160 | 3175 | 738 |
| 798788 | 911 | 926 | TCTGGAGTAAGGAGGG | 31 | 3780 | 3795 | 739 |
| 798789 | 914 | 929 | GTATCTGGAGTAAGGA | 44 | 3783 | 3798 | 740 |
| 798790 | 917 | 932 | CGGGTATCTGGAGTAA | 49 | 3786 | 3801 | 741 |
| 798791 | 920 | 935 | CATCGGGTATCTGGAG | 25 | 3789 | 3804 | 742 |
| 799358 | N/A | N/A | AGCACAAATACATGAA | 52 | 4045 | 4060 | 743 |
| 799359 | N/A | N/A | TGTTAAAGCTGAGCCC | 22 | 4072 | 4087 | 744 |
| 790655 | N/A | N/A | CGTGTTAAAGCTGAGC | 42 | 4074 | 4089 | 745 |
| 799360 | N/A | N/A | CCAAGACACTTCTCTC | 42 | 4106 | 4121 | 746 |
| 799361 | N/A | N/A | GTCCTATTTGGTTCCC | 77 | 4120 | 4135 | 747 |
| 799362 | N/A | N/A | CATCAACCAGTCCTAT | 39 | 4129 | 4144 | 748 |
| 799363 | N/A | N/A | GAGTTATCCCCATCAA | 49 | 4139 | 4154 | 749 |
| 799364 | N/A | N/A | TCCGAGTTATCCCCAT | 73 | 4142 | 4157 | 750 |
| 799365 | N/A | N/A | CTCCGAGTTATCCCCA | 61 | 4143 | 4158 | 751 |
| 799366 | N/A | N/A | TCTCCGAGTTATCCCC | 70 | 4144 | 4159 | 752 |
| 799377 | N/A | N/A | TTGCAGGTGACTGGAG | 15 | 4328 | 4343 | 753 |
| 799378 | N/A | N/A | GAATACTGAGAAAACC | 46 | 4360 | 4375 | 754 |
| 799379 | N/A | N/A | TTTGATAGTCCCTATG | 0 | 4378 | 4393 | 755 |
| 799380 | N/A | N/A | CTCCTACTGTAAGAGG | 1 | 4619 | 4634 | 756 |
| 799381 | N/A | N/A | AACAGATCTATCTCCT | 54 | 4630 | 4645 | 757 |
| 799382 | N/A | N/A | ACTTTTAGCAAACAGA | 82 | 4640 | 4655 | 758 |
| 799383 | N/A | N/A | CACAAAAACCAAGGTT | 40 | 4669 | 4684 | 759 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799384 | N/A | N/A | GGCACAAAAACCAAGG | 40 | 4671 | 4686 | 760 |
| 799385 | N/A | N/A | TGCCCAACCCTTCACT | 31 | 4760 | 4775 | 761 |
| 799386 | N/A | N/A | AGGAGCTAAATGGTGC | 12 | 4773 | 4788 | 762 |
| 799397 | N/A | N/A | AAAACAGAGCTTGGTA | 27 | 5109 | 5124 | 763 |
| 799398 | N/A | N/A | CTTGGAAAATGAACTT | 48 | 5181 | 5196 | 764 |
| 799399 | N/A | N/A | TCCAAATTTGAAGAAT | 0 | 5232 | 5247 | 765 |
| 799400 | N/A | N/A | GGAAAACCTCCAAATT | 0 | 5240 | 5255 | 766 |
| 799401 | N/A | N/A | TCTTTTAAGGAAAACC | 53 | 5248 | 5263 | 767 |
| 799402 | N/A | N/A | GGTCACTGTTCTCTCT | 66 | 5263 | 5278 | 768 |
| 799403 | N/A | N/A | GCTAAGGTCACTGTTC | 0 | 5268 | 5283 | 769 |
| 799404 | N/A | N/A | GGAACATTTACCCCTG | 68 | 5302 | 5317 | 770 |
| 799405 | N/A | N/A | CTGGGAACATTTACCC | 28 | 5305 | 5320 | 771 |
| 799406 | N/A | N/A | GGGAACATGGCCTTTC | 65 | 5344 | 5359 | 772 |
| 799416 | N/A | N/A | AAGACCTGGGTCAGCG | 41 | 5851 | 5866 | 773 |
| 799417 | N/A | N/A | GGCCAAACATTCTCCC | 26 | 5885 | 5900 | 774 |
| 799418 | N/A | N/A | GTAAATGGTCCATGTA | 12 | 5909 | 5924 | 775 |
| 799419 | N/A | N/A | AAAAATTCAACCTAAG | 0 | 5945 | 5960 | 776 |
| 799420 | N/A | N/A | CAAGACCAAAAATTCA | 32 | 5952 | 5967 | 777 |
| 799421 | N/A | N/A | AACCCAAGACCAAAAA | 63 | 5956 | 5971 | 778 |
| 799422 | N/A | N/A | GATTTTAACAGTTGTC | 33 | 6004 | 6019 | 779 |
| 799423 | N/A | N/A | TACCAGGCCCCAGCCC | 14 | 6089 | 6104 | 780 |
| 799424 | N/A | N/A | CTCCAAAGGCTGCAGG | 34 | 6106 | 6121 | 781 |
| 799425 | N/A | N/A | ATTATAGCAAAATGGA | 23 | 6147 | 6162 | 782 |
| 800109 | N/A | N/A | ACAGCCACAAGTCACA | 75 | 6284 | 6299 | 783 |
| 799436 | N/A | N/A | AGCCATTCCTCAAACC | 4 | 6428 | 6443 | 784 |
| 799437 | N/A | N/A | CCAGATCTCAGGTCAA | 26 | 6541 | 6556 | 785 |
| 799438 | N/A | N/A | AAGAGAGAAACGCAGT | 32 | 6558 | 6573 | 786 |
| 799439 | N/A | N/A | AAGAGGGACCTCGGTT | 0 | 6574 | 6589 | 787 |
| 799440 | N/A | N/A | TAGAAAAGTTAAGAGG | 41 | 6584 | 6599 | 788 |
| 799441 | N/A | N/A | CTAGAAAAGTTAAGAG | 22 | 6585 | 6600 | 789 |
| 799442 | N/A | N/A | GATTTTAAAAGAGGCC | 0 | 6600 | 6615 | 790 |
| 799443 | N/A | N/A | TCATGCTGATTTTAAA | 24 | 6607 | 6622 | 791 |
| 799444 | N/A | N/A | CATCATGCTGATTTTA | 45 | 6609 | 6624 | 792 |
| 799445 | N/A | N/A | CCTAATCTCTTTCATC | 28 | 6621 | 6636 | 793 |
| 799456 | N/A | N/A | TCCTAAGTACTGTTAA | 0 | 7139 | 7154 | 794 |
| 799457 | N/A | N/A | CACGATAGTCTCAGCA | 62 | 7170 | 7185 | 795 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799458 | N/A | N/A | TTGAAAACCCAACCCT | 3 | 7246 | 7261 | 796 |
| 799459 | N/A | N/A | ACAGAGTCTTTGAAAA | 0 | 7255 | 7270 | 797 |
| 799460 | N/A | N/A | CAACAGAGTCTTTGAA | 29 | 7257 | 7272 | 798 |
| 799461 | N/A | N/A | CTGCGAGAGAAAAAGA | 62 | 7297 | 7312 | 799 |
| 799462 | N/A | N/A | AAGCACTAGGTTCTGC | 43 | 7309 | 7324 | 800 |
| 799463 | N/A | N/A | TGGTAAGCACTAGGTT | 33 | 7313 | 7328 | 801 |
| 799464 | N/A | N/A | AAGCACTTGGTAAGCA | 40 | 7320 | 7335 | 802 |
| 799465 | N/A | N/A | AGCTCTAGGCCACTCC | 64 | 7362 | 7377 | 803 |
| 799476 | N/A | N/A | GCTCAAAGGGCCACCC | 0 | 7624 | 7639 | 804 |
| 799477 | N/A | N/A | GTTCCATAGGCAGCCA | 4 | 7664 | 7679 | 805 |
| 799478 | N/A | N/A | CCCTACCACCCCTGTG | 17 | 7698 | 7713 | 806 |
| 799479 | N/A | N/A | TGCCCTTCTGCAGTGG | 24 | 7754 | 7769 | 807 |
| 790695 | N/A | N/A | TGAAATGGTGCTCTGC | 62 | 7767 | 7782 | 808 |
| 799480 | N/A | N/A | CACACAGGCAACCACA | 45 | 7793 | 7808 | 809 |
| 799481 | N/A | N/A | CTCCACACAGGCAACC | 34 | 7796 | 7811 | 810 |
| 799482 | N/A | N/A | GAAAAGCCGGGCATCT | 30 | 7872 | 7887 | 811 |
| 799483 | N/A | N/A | CAAAGGAAAAGCCGGG | 35 | 7877 | 7892 | 812 |
| 799484 | N/A | N/A | CGCCACCTTTGGCTGG | 0 | 7919 | 7934 | 813 |
| 799495 | N/A | N/A | CTAACAGGAATATACA | 25 | 8149 | 8164 | 814 |
| 799496 | N/A | N/A | GGGTGAGGTGGCTGCG | 72 | 8226 | 8241 | 815 |
| 799497 | N/A | N/A | AAGAACTCTCCTAAGC | 0 | 8273 | 8288 | 816 |
| 799498 | N/A | N/A | TCAAGAACTCTCCTAA | 31 | 8275 | 8290 | 817 |
| 799499 | N/A | N/A | TCCTTTAGTGGCCTAC | 54 | 8406 | 8421 | 818 |
| 799500 | N/A | N/A | GAGCAGACGGGCAAGT | 28 | 8434 | 8449 | 819 |
| 799501 | N/A | N/A | AAAAGAGCAGACGGGC | 0 | 8438 | 8453 | 820 |
| 799502 | N/A | N/A | CAAATAGGAAAGCCAA | 31 | 8457 | 8472 | 821 |
| 799503 | N/A | N/A | GGCCACCAGGACAATG | 0 | 8513 | 8528 | 822 |
| 799504 | N/A | N/A | AGGAAAGGTGCTGCCC | 15 | 8585 | 8600 | 823 |
| 799515 | N/A | N/A | CCCCAGACCTGCTAAG | 38 | 8941 | 8956 | 824 |
| 790710 | N/A | N/A | GGGAAATGTTCTACCT | 15 | 9005 | 9020 | 825 |
| 799516 | N/A | N/A | CACCAGATCAAGACAG | 0 | 9052 | 9067 | 826 |
| 799517 | N/A | N/A | CTTAAGTAGAGCAAAG | 0 | 9127 | 9142 | 827 |
| 799518 | N/A | N/A | ACTTAAGTAGAGCAAA | 38 | 9128 | 9143 | 828 |
| 799519 | N/A | N/A | AACTTAAGTAGAGCAA | 44 | 9129 | 9144 | 829 |
| 799520 | N/A | N/A | GATTGATGTTGGGCTG | 51 | 9179 | 9194 | 830 |
| 799521 | N/A | N/A | TAAAGACAGGTTTCCC | 57 | 9216 | 9231 | 831 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799522 | N/A | N/A | TTTAAAGACAGGTTTC | 32 | 9218 | 9233 | 832 |
| 799523 | N/A | N/A | GGCAGAAGGCTCTCTC | 28 | 9266 | 9281 | 833 |
| 799270 | N/A | N/A | AGTCAGGCTCAATGAG | 16 | 9403 | 9418 | 834 |
| 799271 | N/A | N/A | CTCGAGTCAGGCTCAA | 60 | 9407 | 9422 | 835 |
| 799280 | N/A | N/A | AGCACCTTGTCACCCG | 44 | 9453 | 9468 | 836 |
| 799281 | N/A | N/A | CACAGCACCTTGTCAC | 25 | 9456 | 9471 | 837 |
| 772786 | N/A | N/A | GACCACAGCACCTTGT | 19 | 9459 | 9474 | 838 |
| 799282 | N/A | N/A | ACAGACCACAGCACCT | 16 | 9462 | 9477 | 839 |
| 799283 | N/A | N/A | AAGACAGACCACAGCA | 34 | 9465 | 9480 | 840 |
| 799284 | N/A | N/A | CGTAAGACAGACCACA | 51 | 9468 | 9483 | 841 |
| 799285 | N/A | N/A | GGCTTCACTGCCCATC | 36 | 9483 | 9498 | 842 |
| 799286 | N/A | N/A | GCTCAGGCTTCACTGC | 0 | 9488 | 9503 | 843 |
| 799287 | N/A | N/A | TCTGCTCAGGCTTCAC | 15 | 9491 | 9506 | 844 |
| 799288 | N/A | N/A | TAATGGTCTGCTCAGG | 23 | 9497 | 9512 | 845 |
| 799299 | N/A | N/A | ATTCCAAAAGGCTGAC | 42 | 9535 | 9550 | 846 |
| 799300 | N/A | N/A | CACATTCCAAAAGGCT | 28 | 9538 | 9553 | 847 |
| 799301 | N/A | N/A | CCACACATTCCAAAAG | 37 | 9541 | 9556 | 848 |
| 799302 | N/A | N/A | AAACCACACATTCCAA | 39 | 9544 | 9559 | 849 |
| 799303 | N/A | N/A | GACAAACCACACATTC | 73 | 9547 | 9562 | 850 |
| 799304 | N/A | N/A | GAAAGACAAACCACAC | 54 | 9551 | 9566 | 851 |
| 799305 | N/A | N/A | CATGAAAGACAAACCA | 0 | 9554 | 9569 | 852 |
| 799306 | N/A | N/A | AAACAGCATGAAAGAC | 27 | 9560 | 9575 | 853 |
| 799307 | N/A | N/A | TCTAAACAGCATGAAA | 10 | 9563 | 9578 | 854 |
| 799308 | N/A | N/A | CGCTCTAAACAGCATG | 47 | 9566 | 9581 | 855 |
| 799319 | N/A | N/A | TGCTGTGGATTTGAAA | 0 | 9638 | 9653 | 856 |
| 799320 | N/A | N/A | GTCTGCTGTGGATTTG | 0 | 9641 | 9656 | 857 |
| 790719 | N/A | N/A | GGACAGTCTGCTGTGG | 86 | 9646 | 9661 | 858 |
| 799321 | N/A | N/A | ATCTGGACAGTCTGCT | 93 | 9650 | 9665 | 859 |
| 798806 | 1013 | 1028 | TGAAAGCCCCCAGGG | 50 | 9710 | 9725 | 860 |
| 799534 | N/A | N/A | GAGAATGAAGTCCAGA | 68 | 9823 | 9838 | 861 |
| 799535 | N/A | N/A | AACTTAAGGCATATAA | 42 | 9843 | 9858 | 862 |
| 799536 | N/A | N/A | ACCGATGCATCCAACT | 50 | 9855 | 9870 | 863 |
| 799537 | N/A | N/A | GGGCACCACAATGTCA | 3 | 9873 | 9888 | 864 |
| 799538 | N/A | N/A | TGCAGGATGAGGAGCT | 29 | 9892 | 9907 | 865 |
| 799539 | N/A | N/A | CCCGTCCACGGAACGG | 41 | 9933 | 9948 | 866 |
| 799540 | N/A | N/A | AGCTGAAGCCCCCAA | 76 | 10020 | 10035 | 867 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799541 | N/A | N/A | TTAATGACACCAAAGT | 55 | 10041 | 10056 | 868 |
| 799542 | N/A | N/A | GTTAATGACACCAAAG | 30 | 10042 | 10057 | 869 |
| 799543 | N/A | N/A | TCAAATGCATGAGTTA | 65 | 10054 | 10069 | 870 |
| 799554 | N/A | N/A | TACCTGTGAGCCCTGA | 0 | 10324 | 10339 | 871 |
| 799555 | N/A | N/A | TACCCCGTGCCTGTCA | 51 | 10386 | 10401 | 872 |
| 799556 | N/A | N/A | ACAACAATGCTCTGGC | 68 | 10402 | 10417 | 873 |
| 799557 | N/A | N/A | AGCCAGTTCTTAGAAA | 28 | 10548 | 10563 | 874 |
| 799558 | N/A | N/A | CTTCTATTCGAGCTGC | 47 | 10652 | 10667 | 875 |
| 799559 | N/A | N/A | AGCTTCTATTCGAGCT | 37 | 10654 | 10669 | 876 |
| 799560 | N/A | N/A | GGCACAGCTTCTATTC | 18 | 10659 | 10674 | 877 |
| 799561 | N/A | N/A | GGAATGAACTTTGCCT | 45 | 10766 | 10781 | 878 |
| 799562 | N/A | N/A | GAAGAGGAGAGCCGGG | 39 | 10796 | 10811 | 879 |
| 799563 | N/A | N/A | AAAACAAACAAGGGTC | 68 | 10845 | 10860 | 880 |
| 799574 | N/A | N/A | CATTCAGGGTTTAAAA | 7 | 11147 | 11162 | 881 |
| 799575 | N/A | N/A | CACATTCAGGGTTTAA | 38 | 11149 | 11164 | 882 |
| 799576 | N/A | N/A | GAAAGGACCCTTTCAA | 25 | 11223 | 11238 | 883 |
| 799577 | N/A | N/A | TTCCGAAAGGACCCTT | 55 | 11227 | 11242 | 884 |
| 799578 | N/A | N/A | ACCTTCCGAAAGGACC | 76 | 11230 | 11245 | 885 |
| 799579 | N/A | N/A | AACCTTCCGAAAGGAC | 51 | 11231 | 11246 | 886 |
| 799580 | N/A | N/A | AAACCTTCCGAAAGGA | 33 | 11232 | 11247 | 887 |
| 799581 | N/A | N/A | CAAACCTTCCGAAAGG | 0 | 11233 | 11248 | 888 |
| 799582 | N/A | N/A | ACAAACCTTCCGAAAG | 19 | 11234 | 11249 | 889 |
| 772801 | N/A | N/A | GACAAACCTTCCGAAA | 34 | 11235 | 11250 | 890 |
| 799593 | N/A | N/A | GAAGGAGCTCAAACTT | 0 | 11996 | 12011 | 891 |
| 799594 | N/A | N/A | TGAACGGAAAGAAGAA | 35 | 12009 | 12024 | 892 |
| 799595 | N/A | N/A | CTCTGAACGGAAAGAA | 35 | 12012 | 12027 | 893 |
| 799596 | N/A | N/A | ACTCTGAACGGAAAGA | 49 | 12013 | 12028 | 894 |
| 799597 | N/A | N/A | AACTCTGAACGGAAAG | 46 | 12014 | 12029 | 895 |
| 799598 | N/A | N/A | CAACTCTGAACGGAAA | 39 | 12015 | 12030 | 896 |
| 799599 | N/A | N/A | CCAACTCTGAACGGAA | 12 | 12016 | 12031 | 897 |
| 799600 | N/A | N/A | GCACCAACTCTGAACG | 63 | 12019 | 12034 | 898 |
| 799601 | N/A | N/A | GAATACACTGCACCAA | 48 | 12028 | 12043 | 899 |
| 799602 | N/A | N/A | CCATTATGAATACACT | 51 | 12035 | 12050 | 900 |
| 799613 | N/A | N/A | TCACATTCGGCTGTTT | 17 | 12600 | 12615 | 901 |
| 799614 | N/A | N/A | GGCCTTTGAGCACACC | 37 | 12644 | 12659 | 902 |
| 799615 | N/A | N/A | GGAGAGGACCGGCCTT | 24 | 12654 | 12669 | 903 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 772813 | N/A | N/A | AAGGGCGCAGGAAAGG | 43 | 12704 | 12719 | 904 |
| 799616 | N/A | N/A | GGCTCCTACCCGCCCA | 80 | 12745 | 12760 | 905 |
| 799617 | N/A | N/A | CAACCTGCAGCCAGCA | 50 | 12773 | 12788 | 906 |
| 799618 | N/A | N/A | AACAAAGCTGCAATGC | 0 | 12797 | 12812 | 907 |
| 799619 | N/A | N/A | ACGACCAGGCCTGTCG | 9 | 12840 | 12855 | 908 |
| 799620 | N/A | N/A | TAACGACCAGGCCTGT | 31 | 12842 | 12857 | 909 |
| 799621 | N/A | N/A | TTTCACTGCAAGTCCC | 49 | 12858 | 12873 | 910 |
| 799632 | N/A | N/A | CTGCCAAATCACAAAG | 48 | 13237 | 13252 | 911 |
| 799633 | N/A | N/A | AGACTGCCAAATCACA | 25 | 13240 | 13255 | 912 |
| 799634 | N/A | N/A | CAGACTGCCAAATCAC | 23 | 13241 | 13256 | 913 |
| 799635 | N/A | N/A | ACAGACTGCCAAATCA | 28 | 13242 | 13257 | 914 |
| 799636 | N/A | N/A | CACAGACTGCCAAATC | 55 | 13243 | 13258 | 915 |
| 799637 | N/A | N/A | GCACAGACTGCCAAAT | 48 | 13244 | 13259 | 916 |
| 799638 | N/A | N/A | AGTCAGGCACAGACTG | 53 | 13250 | 13265 | 917 |
| 799639 | N/A | N/A | CCAGAGAGTCAGGCAC | 34 | 13256 | 13271 | 918 |
| 799640 | N/A | N/A | CAAGGACCTGTTCTGG | 40 | 13301 | 13316 | 919 |
| 799641 | N/A | N/A | CATCAGACCTCTCCCA | 33 | 13360 | 13375 | 920 |
| 799652 | N/A | N/A | ACTCAAACCAGGACAG | 0 | 13538 | 13553 | 921 |
| 799653 | N/A | N/A | ACCCACTCAAACCAGG | 51 | 13542 | 13557 | 922 |
| 799654 | N/A | N/A | GCTGAATAACCTACAA | 22 | 13584 | 13599 | 923 |
| 799655 | N/A | N/A | TGCAGCTGAATAACCT | 47 | 13588 | 13603 | 924 |
| 799656 | N/A | N/A | CTAACTGGGCAGGTCC | 60 | 13668 | 13683 | 925 |
| 799657 | N/A | N/A | TACAAGTGGTTGCTGG | 62 | 13699 | 13714 | 926 |
| 799658 | N/A | N/A | AACTACAAGTGGTTGC | 22 | 13702 | 13717 | 927 |
| 799659 | N/A | N/A | AAATAACTACAAGTGG | 57 | 13706 | 13721 | 928 |
| 799660 | N/A | N/A | TGGGAGCACTTCTTTT | 35 | 13729 | 13744 | 929 |
| 799661 | N/A | N/A | CTCCACTGCCTCCTAC | 44 | 13763 | 13778 | 930 |
| 799672 | N/A | N/A | ACAGGATGGAGCAATG | 41 | 14114 | 14129 | 931 |
| 799673 | N/A | N/A | CTGATTAACTTTCCTT | 64 | 14133 | 14148 | 932 |
| 799674 | N/A | N/A | GATCACAATTCCAAGC | 48 | 14177 | 14192 | 933 |
| 799675 | N/A | N/A | TCCCAGTTCATGATCA | 0 | 14188 | 14203 | 934 |
| 799676 | N/A | N/A | GAAACCATGAGCTGTT | 64 | 14268 | 14283 | 935 |
| 799677 | N/A | N/A | GCTCATGAGCATTTGG | 68 | 14359 | 14374 | 936 |
| 799678 | N/A | N/A | CACAAGCACCTGTCCA | 0 | 14396 | 14411 | 937 |
| 799679 | N/A | N/A | CTGCAGGGTACTAAGG | 0 | 14441 | 14456 | 938 |
| 799680 | N/A | N/A | GAGTTCTAGGCCGTCA | 33 | 14471 | 14486 | 939 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799681 | N/A | N/A | ACTCATCCTGTTGGCA | 53 | 14518 | 14533 | 940 |
| 799692 | N/A | N/A | ACACAGTAACAACAAT | 0 | 15426 | 15441 | 941 |
| 799693 | N/A | N/A | TTATGACACAGTAACA | 17 | 15431 | 15446 | 942 |
| 799694 | N/A | N/A | AAGGAATTATGACACA | 7 | 15437 | 15452 | 943 |
| 799695 | N/A | N/A | CCAGGAACCAGCACTT | 6 | 15564 | 15579 | 944 |
| 799696 | N/A | N/A | AAGTTATCTGGGAAGC | 43 | 15613 | 15628 | 945 |
| 799697 | N/A | N/A | AATAGTTTTCTCTCAA | 59 | 15651 | 15666 | 946 |
| 799698 | N/A | N/A | TAATAGTTTTCTCTCA | 33 | 15652 | 15667 | 947 |
| 799699 | N/A | N/A | CAAAACAGTGGACCAT | 57 | 15678 | 15693 | 948 |
| 799700 | N/A | N/A | CATGACAGCAAAGCAA | 49 | 15691 | 15706 | 949 |
| 799701 | N/A | N/A | CTACAGTTCCAGAACA | 46 | 15762 | 15777 | 950 |
| 799712 | N/A | N/A | ATAGATTATCCAAGTA | 70 | 15903 | 15918 | 951 |
| 799713 | N/A | N/A | CACAATCACTGTTCCT | 0 | 15920 | 15935 | 952 |
| 799714 | N/A | N/A | CACCAAAACAAGTGTC | 33 | 15988 | 16003 | 953 |
| 799715 | N/A | N/A | CCTCAGGGCTGCCACC | 32 | 16000 | 16015 | 954 |
| 799716 | N/A | N/A | GGCTACCAGCCTTGCT | 32 | 16046 | 16061 | 955 |
| 799717 | N/A | N/A | GCAGGCTACCAGCCTT | 0 | 16049 | 16064 | 956 |
| 799718 | N/A | N/A | CTGCTAGGGATACTGA | 65 | 16230 | 16245 | 957 |
| 799719 | N/A | N/A | CCTTTCTACTAGAAAA | 19 | 16285 | 16300 | 958 |
| 799720 | N/A | N/A | ACACACAGCAGAAGGC | 40 | 16408 | 16423 | 959 |
| 799721 | N/A | N/A | GTAACACACAGCAGAA | 42 | 16411 | 16426 | 960 |
| 799731 | N/A | N/A | CTTTCTTGGTGTGTTA | 37 | 16951 | 16966 | 961 |
| 799732 | N/A | N/A | GGGATCAGGTGAGTGT | 48 | 16969 | 16984 | 962 |
| 799733 | N/A | N/A | GTTTAGGTAGAGTGGC | 27 | 16986 | 17001 | 963 |
| 799734 | N/A | N/A | TCCCAGGTGAACCCAC | 45 | 17055 | 17070 | 964 |
| 799735 | N/A | N/A | TCCACGGGAGTGGAAG | 0 | 17079 | 17094 | 965 |
| 799736 | N/A | N/A | TTCTACACCTTTTAAG | 56 | 17155 | 17170 | 966 |
| 799737 | N/A | N/A | CTTAGAGTATAAATAC | 5 | 17178 | 17193 | 967 |
| 799738 | N/A | N/A | TCAAAAAATGTCCCCA | 50 | 17195 | 17210 | 968 |
| 799739 | N/A | N/A | CACCCCTATCAAAAAA | 0 | 17203 | 17218 | 969 |
| 799740 | N/A | N/A | TTAAATAACTGTCCTC | 48 | 17254 | 17269 | 970 |
| 799751 | N/A | N/A | GAGCTAATGACACTGG | 60 | 17699 | 17714 | 971 |
| 799752 | N/A | N/A | TTAAAACTGAGCTAAT | 0 | 17707 | 17722 | 972 |
| 799753 | N/A | N/A | CGTGAGTAAATTCTTA | 69 | 17767 | 17782 | 973 |
| 799754 | N/A | N/A | GGCTAAGTGCCAGGTG | 0 | 17831 | 17846 | 974 |
| 799755 | N/A | N/A | GAAAGTTACAGAACTC | 77 | 17906 | 17921 | 975 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799756 | N/A | N/A | CAGGGCAGCTCCGAGA | 44 | 17968 | 17983 | 976 |
| 799757 | N/A | N/A | CCGTTACTGGACACAG | 41 | 17990 | 18005 | 977 |
| 799758 | N/A | N/A | CACCGTTACTGGACAC | 57 | 17992 | 18007 | 978 |
| 799759 | N/A | N/A | ACCATATCACTCCTTC | 66 | 18021 | 18036 | 979 |
| 799760 | N/A | N/A | TTCTAGGTGAACCATA | 58 | 18031 | 18046 | 980 |
| 799771 | N/A | N/A | GCATATGCCACTGAGA | 0 | 18475 | 18490 | 981 |
| 799772 | N/A | N/A | CGCCGCGGCATATGCC | 30 | 18482 | 18497 | 982 |
| 799773 | N/A | N/A | CGCTAGGTCACACTCA | 43 | 18500 | 18515 | 983 |
| 799774 | N/A | N/A | GCCCTGTTCTGCGCTA | 0 | 18511 | 18526 | 984 |
| 799775 | N/A | N/A | ACACAAGAGGGAAGCC | 22 | 18524 | 18539 | 985 |
| 799776 | N/A | N/A | CAGAAGGACCAAGTCC | 11 | 18563 | 18578 | 986 |
| 799777 | N/A | N/A | AGTCAGCCAGAAGGAC | 34 | 18570 | 18585 | 987 |
| 799778 | N/A | N/A | GCACACCTTCCAAGCA | 10 | 18589 | 18604 | 988 |
| 799779 | N/A | N/A | TAAACAAACCACAGGG | 19 | 18690 | 18705 | 989 |
| 799780 | N/A | N/A | CCATAAACAAACCACA | 28 | 18693 | 18708 | 990 |
| 799791 | N/A | N/A | GGGAGACCTACCTCTG | 56 | 19070 | 19085 | 991 |
| 799792 | N/A | N/A | ACCAAAACCCGGGAGA | 31 | 19080 | 19095 | 992 |
| 799793 | N/A | N/A | GTTCTTCCTGCTGTCA | 30 | 19137 | 19152 | 993 |
| 799794 | N/A | N/A | AACCACAGCTCCTGTT | 0 | 19150 | 19165 | 994 |
| 799795 | N/A | N/A | CCAGATGTTTCCCCAC | 66 | 19263 | 19278 | 995 |
| 799796 | N/A | N/A | CATTAGATACTGTCTT | 43 | 19280 | 19295 | 996 |
| 799797 | N/A | N/A | GACATTAGATACTGTC | 27 | 19282 | 19297 | 997 |
| 799798 | N/A | N/A | TCCCACTTCTCCTCTG | 50 | 19306 | 19321 | 998 |
| 799799 | N/A | N/A | AAAACATCCCACTTCT | 28 | 19312 | 19327 | 999 |
| 799800 | N/A | N/A | TTACAAAGGGAAAGTC | 28 | 19342 | 19357 | 1000 |
| 799811 | N/A | N/A | CTGCCAACGGCACAGT | 0 | 19880 | 19895 | 1001 |
| 799812 | N/A | N/A | CAGACAGCTAATCTGC | 39 | 19892 | 19907 | 1002 |
| 799813 | N/A | N/A | ATGCAGACAGCTAATC | 16 | 19895 | 19910 | 1003 |
| 799814 | N/A | N/A | CCTCACTTAGCCTGCA | 0 | 20006 | 20021 | 1004 |
| 799815 | N/A | N/A | CTCTTGATGATCCTCA | 68 | 20017 | 20032 | 1005 |
| 799816 | N/A | N/A | TGACAAGGTCCCCAGG | 19 | 20038 | 20053 | 1006 |
| 799817 | N/A | N/A | TACTGATTCATGAGGG | 45 | 20090 | 20105 | 1007 |
| 799818 | N/A | N/A | CACTGATAACTAACTT | 24 | 20125 | 20140 | 1008 |
| 799819 | N/A | N/A | CCCCACTGAGCAGGAG | 26 | 20186 | 20201 | 1009 |
| 799820 | N/A | N/A | CCCCAGCAGGGTTTTG | 0 | 20209 | 20224 | 1010 |
| 799831 | N/A | N/A | TACTTGGAAGAGTTTG | 18 | 20664 | 20679 | 1011 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799832 | N/A | N/A | CACCCATACTTGGAAG | 14 | 20670 | 20685 | 1012 |
| 799833 | N/A | N/A | TTTCTGAACAGAGTCC | 39 | 20694 | 20709 | 1013 |
| 799834 | N/A | N/A | GTGGTATAGCATGCAT | 0 | 20711 | 20726 | 1014 |
| 799835 | N/A | N/A | GCAGATGTATACAAAT | 70 | 20728 | 20743 | 1015 |
| 799836 | N/A | N/A | AGATATCGGCCCCCTG | 61 | 20743 | 20758 | 1016 |
| 799837 | N/A | N/A | TCATAAGCATAGATTT | 38 | 20800 | 20815 | 1017 |
| 799838 | N/A | N/A | TTGCACCCCCATAACT | 2 | 20821 | 20836 | 1018 |
| 799839 | N/A | N/A | AGCACAATATGAATGT | 36 | 20943 | 20958 | 1019 |
| 799840 | N/A | N/A | AGGGAAGTTAGTGTTT | 22 | 21022 | 21037 | 1020 |
| 799851 | N/A | N/A | AAGTGTCCATCAAGCA | 70 | 21276 | 21291 | 1021 |
| 799852 | N/A | N/A | CAAGTGTCCATCAAGC | 11 | 21277 | 21292 | 1022 |
| 799853 | N/A | N/A | CCAAGTGTCCATCAAG | 42 | 21278 | 21293 | 1023 |
| 799854 | N/A | N/A | GCCAAGTGTCCATCAA | 45 | 21279 | 21294 | 1024 |
| 799855 | N/A | N/A | AGCCAAGTGTCCATCA | 52 | 21280 | 21295 | 1025 |
| 799856 | N/A | N/A | GCAAGCCAAGTGTCCA | 43 | 21283 | 21298 | 1026 |
| 799857 | N/A | N/A | AGAACTGAAAGCGGCG | 31 | 21363 | 21378 | 1027 |
| 799858 | N/A | N/A | GTAATTTAGCAATTCC | 64 | 21400 | 21415 | 1028 |
| 799859 | N/A | N/A | TGTAATTTAGCAATTC | 32 | 21401 | 21416 | 1029 |
| 799860 | N/A | N/A | TGCCGACACATGAGGC | 0 | 21476 | 21491 | 1030 |
| 799871 | N/A | N/A | TTGGACACACTCACTG | 0 | 21912 | 21927 | 1031 |
| 799872 | N/A | N/A | AAGTTAATCATTACTT | 0 | 21959 | 21974 | 1032 |
| 799873 | N/A | N/A | AAAAGTTAATCATTAC | 0 | 21961 | 21976 | 1033 |
| 799874 | N/A | N/A | CAGACTGGAAAAGTTA | 0 | 21969 | 21984 | 1034 |
| 799875 | N/A | N/A | GTGCAGACTGGAAAAG | 41 | 21972 | 21987 | 1035 |
| 799876 | N/A | N/A | GCCAGGGCCGCACTGT | 55 | 22029 | 22044 | 1036 |
| 799877 | N/A | N/A | ACTTTACAACCCAATA | 52 | 22060 | 22075 | 1037 |
| 799878 | N/A | N/A | GCCCCCCTCCCCGTGC | 70 | 22101 | 22116 | 1038 |
| 799879 | N/A | N/A | TGGAAAAGCTCCTTCT | 3 | 22139 | 22154 | 1039 |
| 799880 | N/A | N/A | TCCGATGGAAAAGCTC | 39 | 22144 | 22159 | 1040 |
| 799891 | N/A | N/A | ATCATTAAGCCAATTT | 0 | 22556 | 22571 | 1041 |
| 799892 | N/A | N/A | GCATCATTAAGCCAAT | 54 | 22558 | 22573 | 1042 |
| 799893 | N/A | N/A | ATACAAACCACTGCAT | 0 | 22570 | 22585 | 1043 |
| 799894 | N/A | N/A | TCCCAACTGGGCAGCT | 2 | 22711 | 22726 | 1044 |
| 799895 | N/A | N/A | CTGAGAGTGTAGGAGA | 50 | 22750 | 22765 | 1045 |
| 799896 | N/A | N/A | CTTACCTCACCCACCT | 36 | 22780 | 22795 | 1046 |
| 799897 | N/A | N/A | TCTCTTACCTCACCCA | 27 | 22783 | 22798 | 1047 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 799898 | N/A | N/A | GTCTCTTACCTCACCC | 37 | 22784 | 22799 | 1048 |
| 799899 | N/A | N/A | AAGTCTCTTACCTCAC | 33 | 22786 | 22801 | 1049 |
| 799900 | N/A | N/A | CAAGTCTCTTACCTCA | 51 | 22787 | 22802 | 1050 |
| 799910 | N/A | N/A | CCAACTCCATTCATAA | 36 | 23119 | 23134 | 1051 |
| 799911 | N/A | N/A | AGCCAACTCCATTCAT | 0 | 23121 | 23136 | 1052 |
| 799912 | N/A | N/A | CTCAGAGGAAGGGTGG | 22 | 23150 | 23165 | 1053 |
| 799913 | N/A | N/A | GGCCTCAGAGGAAGGG | 18 | 23153 | 23168 | 1054 |
| 799914 | N/A | N/A | CTGAGAGAGGCCTCAG | 24 | 23161 | 23176 | 1055 |
| 799915 | N/A | N/A | GCTGACGCGGCTTCCT | 52 | 23268 | 23283 | 1056 |
| 799916 | N/A | N/A | CACAAATCAAAAGCTC | 47 | 23304 | 23319 | 1057 |
| 799917 | N/A | N/A | TGGAGAATGTAATTGA | 17 | 23349 | 23364 | 1058 |
| 799918 | N/A | N/A | CATTTATCTCGCCATG | 16 | 23363 | 23378 | 1059 |
| 799919 | N/A | N/A | TCCTAAGAGCATTTAT | 0 | 23372 | 23387 | 1060 |
| 799930 | N/A | N/A | TCTTTTATCACTGTCA | 8 | 23649 | 23664 | 1061 |
| 799932 | N/A | N/A | TCAAGAGACGGTGAGC | 0 | 23680 | 23695 | 1062 |
| 799933 | N/A | N/A | TACTATTCATCACCCT | 22 | 23695 | 23710 | 1063 |
| 799934 | N/A | N/A | ACTTTTTACTCTGTCT | 61 | 23711 | 23726 | 1064 |
| 799935 | N/A | N/A | AGAAATGACTTTTTAC | 42 | 23718 | 23733 | 1065 |
| 799936 | N/A | N/A | CTTTAATTTCAGAGTC | 44 | 23734 | 23749 | 1066 |
| 799937 | N/A | N/A | TCTTTAATTTCAGAGT | 24 | 23735 | 23750 | 1067 |
| 799938 | N/A | N/A | CTCTAAACCAACTTTT | 17 | 23756 | 23771 | 1068 |
| 799939 | N/A | N/A | GCATTTAATTTGCAAC | 38 | 23832 | 23847 | 1069 |
| 799950 | N/A | N/A | GCACAAGTCACTGGCC | 0 | 24279 | 24294 | 1070 |
| 799951 | N/A | N/A | TCTTAAAAAAGGGAG | 0 | 24308 | 24323 | 1071 |
| 799952 | N/A | N/A | CTCTAAGTGGCTCATG | 30 | 24359 | 24374 | 1072 |
| 799953 | N/A | N/A | AGAAAATGCCCACCAG | 0 | 24471 | 24486 | 1073 |
| 799954 | N/A | N/A | CAGAAAATGCCCACCA | 42 | 24472 | 24487 | 1074 |
| 799955 | N/A | N/A | CGCTCAGAAAATGCCC | 50 | 24476 | 24491 | 1075 |
| 799956 | N/A | N/A | TCTCCAGCCGCTCAGA | 57 | 24484 | 24499 | 1076 |
| 799957 | N/A | N/A | TCTGAGGCTCCTGGGT | 11 | 24500 | 24515 | 1077 |
| 799958 | N/A | N/A | GTGGAGAGTGCTGCAC | 23 | 24532 | 24547 | 1078 |
| 799959 | N/A | N/A | AGCTTGTGGAGAGTGC | 1 | 24537 | 24552 | 1079 |
| 799970 | N/A | N/A | TCCTCAGGAAACACAG | 43 | 25075 | 25090 | 1080 |
| 799971 | N/A | N/A | GTAAAACTTGCTGAGA | 31 | 25182 | 25197 | 1081 |
| 799972 | N/A | N/A | CACAAGGACCCTTGCT | 0 | 25244 | 25259 | 1082 |
| 799973 | N/A | N/A | ATAATTCACAAGGACC | 0 | 25250 | 25265 | 1083 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799974 | N/A | N/A | GACTCCAGTGCCAATC | 23 | 25295 | 25310 | 1084 |
| 799975 | N/A | N/A | TCTTCAGGGACAAGCC | 38 | 25324 | 25339 | 1085 |
| 799976 | N/A | N/A | TCAAAGGTTAACAGCA | 34 | 25397 | 25412 | 1086 |
| 799977 | N/A | N/A | GGACATCTCAAAGGTT | 36 | 25404 | 25419 | 1087 |
| 799978 | N/A | N/A | CTCCACAACGGACATC | 24 | 25413 | 25428 | 1088 |
| 799979 | N/A | N/A | AACGGTTGCCTCATCC | 38 | 25438 | 25453 | 1089 |
| 799990 | N/A | N/A | TTGCACCTGGCAACCT | 0 | 25527 | 25542 | 1090 |
| 799991 | N/A | N/A | GGCCGCCTCCTGCAGG | 19 | 25596 | 25611 | 1091 |
| 799992 | N/A | N/A | GGCACGGCCGCCTCCT | 9 | 25601 | 25616 | 1092 |
| 799993 | N/A | N/A | ATAATGAAGTGATATT | 0 | 25725 | 25740 | 1093 |
| 799994 | N/A | N/A | ACTTGGATAATGAAGT | 2 | 25731 | 25746 | 1094 |
| 799995 | N/A | N/A | CTGTGAGGCACTTGGA | 63 | 25740 | 25755 | 1095 |
| 799996 | N/A | N/A | GACCCACGGTTAAATG | 36 | 25827 | 25842 | 1096 |
| 799997 | N/A | N/A | ATGACCCACGGTTAAA | 14 | 25829 | 25844 | 1097 |
| 799998 | N/A | N/A | CAGTAAAGACATGAGC | 45 | 25856 | 25871 | 1098 |
| 799999 | N/A | N/A | TTAGGAACAAGGGCAA | 23 | 25888 | 25903 | 1099 |
| 800010 | N/A | N/A | GTTATTTAATTACCCT | 69 | 26603 | 26618 | 1100 |
| 790847 | N/A | N/A | TCTTACAAAGAGTTAT | 24 | 26614 | 26629 | 1101 |
| 800011 | N/A | N/A | CTTCAGCCTGTGTTTG | 21 | 26672 | 26687 | 1102 |
| 800012 | N/A | N/A | GAGGACTTCAGCCTGT | 49 | 26677 | 26692 | 1103 |
| 800013 | N/A | N/A | AAAGGAGAGGACTTCA | 56 | 26683 | 26698 | 1104 |
| 800014 | N/A | N/A | TAAAGCATAAAATCCT | 21 | 26732 | 26747 | 1105 |
| 800015 | N/A | N/A | CTTTAAGGTGTTGCCC | 26 | 26772 | 26787 | 1106 |
| 800016 | N/A | N/A | GTTCATTTTAAAGCAT | 32 | 26913 | 26928 | 1107 |
| 800017 | N/A | N/A | TAAAACAGTATGTGTT | 11 | 26926 | 26941 | 1108 |
| 800018 | N/A | N/A | AAAACTCACAGTCCTT | 51 | 27028 | 27043 | 1109 |
| 800029 | N/A | N/A | CCTGAATCGGGCCCAC | 0 | 27192 | 27207 | 1110 |
| 800030 | N/A | N/A | AAACACAGTTCCCTGA | 0 | 27203 | 27218 | 1111 |
| 800031 | N/A | N/A | AGAAACACAGTTCCCT | 52 | 27205 | 27220 | 1112 |
| 800032 | N/A | N/A | GAATTCCCCGCCATTT | 0 | 27258 | 27273 | 1113 |
| 800033 | N/A | N/A | CACTACAGAGATTCCC | 52 | 27283 | 27298 | 1114 |
| 800034 | N/A | N/A | CCGCACGACATCCCCC | 47 | 27304 | 27319 | 1115 |
| 800035 | N/A | N/A | CAAAGGCCCCTCGAAC | 34 | 27357 | 27372 | 1116 |
| 800036 | N/A | N/A | GTTAGGACAGCTCCAG | 38 | 27444 | 27459 | 1117 |
| 800037 | N/A | N/A | CACCAGCAGCCTCTGT | 0 | 27466 | 27481 | 1118 |
| 800038 | N/A | N/A | TGCTCCTCCCTCGCTG | 2 | 27498 | 27513 | 1119 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 800049 | N/A | N/A | AACAAACCTGGCCTGG | 7 | 28026 | 28041 | 1120 |
| 800050 | N/A | N/A | GCTTATTTTCCCAATT | 10 | 28048 | 28063 | 1121 |
| 800051 | N/A | N/A | CAGCACATCCACCCTT | 20 | 28104 | 28119 | 1122 |
| 800052 | N/A | N/A | CCCTCTTCCGGGAGGC | 0 | 28121 | 28136 | 1123 |
| 800053 | N/A | N/A | CTACACCAAAGACCTG | 63 | 28191 | 28206 | 1124 |
| 800054 | N/A | N/A | GCTACACCAAAGACCT | 62 | 28192 | 28207 | 1125 |
| 800055 | N/A | N/A | ATAAACTTGTGAGCGC | 8 | 28252 | 28267 | 1126 |
| 800056 | N/A | N/A | TGCTAATAAACTTGTG | 7 | 28257 | 28272 | 1127 |
| 800057 | N/A | N/A | TTCACTTGTTTCTGCA | 46 | 28287 | 28302 | 1128 |
| 800058 | N/A | N/A | TCATCAGGCATTCACT | 51 | 28297 | 28312 | 1129 |
| 800069 | N/A | N/A | CATGGCGGAAGATGGG | 25 | 28849 | 28864 | 1130 |
| 800070 | N/A | N/A | CCATGGCGGAAGATGG | 9 | 28850 | 28865 | 1131 |
| 800071 | N/A | N/A | TGTATTTGTTAACAAA | 2 | 29077 | 29092 | 1132 |
| 800072 | N/A | N/A | GACTTGGGACCATAAA | 0 | 29160 | 29175 | 1133 |
| 800073 | N/A | N/A | TAAGTAGGAGCCAGCG | 39 | 29187 | 29202 | 1134 |
| 800074 | N/A | N/A | GGGCATTCTGACTCCT | 33 | 29206 | 29221 | 1135 |
| 800075 | N/A | N/A | TAATTTTCCTCAACAG | 55 | 29278 | 29293 | 1136 |
| 800076 | N/A | N/A | CGCTTCCCTACACAGT | 25 | 29336 | 29351 | 1137 |
| 800077 | N/A | N/A | CCTTAACAAAGCTTCC | 36 | 29524 | 29539 | 1138 |
| 800078 | N/A | N/A | ACCTTAACAAAGCTTC | 51 | 29525 | 29540 | 1139 |
| 800089 | N/A | N/A | AGGAACCTATCTGGTA | 0 | 29690 | 29705 | 1140 |
| 800090 | N/A | N/A | CACCTATGCGATGGTC | 0 | 29751 | 29766 | 1141 |
| 800091 | N/A | N/A | TGACACAGCCAGAGCT | 0 | 29794 | 29809 | 1142 |
| 800092 | N/A | N/A | ATCCTGATGAGAAAAC | 0 | 29847 | 29862 | 1143 |
| 800093 | N/A | N/A | TTGAAGGCCAGCTCCT | 48 | 29876 | 29891 | 1144 |
| 800094 | N/A | N/A | ATGGAACCTTGAAGGC | 49 | 29884 | 29899 | 1145 |
| 800095 | N/A | N/A | AGTTACAGATCTTTCA | 47 | 29905 | 29920 | 1146 |
| 800096 | N/A | N/A | TGGAGTTACAGATCTT | 32 | 29908 | 29923 | 1147 |
| 800097 | N/A | N/A | GCCTCAAAAAGCCTCA | 1 | 29933 | 29948 | 1148 |
| 800098 | N/A | N/A | TTTTAGGGCCTCAAAA | 1 | 29940 | 29955 | 1149 |
| 790507 | 1028 | 1043 | AAGAAGTTGGGAATCT | 0 | 30295 | 30310 | 1150 |
| 772597 | 1072 | 1087 | CAGTATGCCACCACGC | 0 | 30339 | 30354 | 1151 |
| 798819 | 1075 | 1090 | TCCCAGTATGCCACCA | 0 | 30342 | 30357 | 1152 |
| 798820 | 1080 | 1095 | TCTCCTCCCAGTATGC | 24 | 30347 | 30362 | 1153 |
| 798821 | 1099 | 1114 | AGCCTCCCCACTCTCG | 32 | 30366 | 30381 | 1154 |
| 798822 | 1103 | 1118 | GTAGAGCCTCCCCACT | 56 | 30370 | 30385 | 1155 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798823 | 1106 | 1121 | ACAGTAGAGCCTCCCC | 74 | 30373 | 30388 | 1156 |
| 798824 | 1109 | 1124 | GACACAGTAGAGCCTC | 74 | 30376 | 30391 | 1157 |
| 798825 | 1112 | 1127 | CTGGACACAGTAGAGC | 24 | 30379 | 30394 | 1158 |
| 798826 | 1115 | 1130 | CTCCTGGACACAGTAG | 14 | 30382 | 30397 | 1159 |
| 798827 | 1123 | 1138 | AGAGAGGGCTCCTGGA | 21 | 30390 | 30405 | 1160 |
| 798835 | 1167 | 1182 | CGAGGCAAAAGCCATT | 22 | 30434 | 30449 | 1161 |
| 798836 | 1170 | 1185 | GTCCGAGGCAAAAGCC | 56 | 30437 | 30452 | 1162 |
| 798837 | 1173 | 1188 | GCTGTCCGAGGCAAAA | 33 | 30440 | 30455 | 1163 |
| 772613 | 1178 | 1193 | ATTGAGCTGTCCGAGG | 7 | 30445 | 30460 | 1164 |
| 798838 | 1182 | 1197 | CCGAATTGAGCTGTCC | 58 | 30449 | 30464 | 1165 |
| 798839 | 1187 | 1202 | GTTGTCCGAATTGAGC | 47 | 30454 | 30469 | 1166 |
| 798840 | 1192 | 1207 | CTCTTGTTGTCCGAAT | 56 | 30459 | 30474 | 1167 |
| 798841 | 1196 | 1211 | CTGACTCTTGTTGTCC | 0 | 30463 | 30478 | 1168 |
| 798842 | 1199 | 1214 | CAGCTGACTCTTGTTG | 0 | 30466 | 30481 | 1169 |
| 790513 | 1202 | 1217 | CACCAGCTGACTCTTG | 10 | 30469 | 30484 | 1170 |
| 798853 | 1265 | 1280 | CCACACACCATCCACC | 7 | 30532 | 30547 | 1171 |
| 798854 | 1270 | 1285 | TACACCCACACACCAT | 25 | 30537 | 30552 | 1172 |
| 798855 | 1273 | 1288 | TTGTACACCCACACAC | 11 | 30540 | 30555 | 1173 |
| 798856 | 1278 | 1293 | TGCGGTTGTACACCCA | 67 | 30545 | 30560 | 1174 |
| 798857 | 1281 | 1296 | TGCTGCGGTTGTACAC | 11 | 30548 | 30563 | 1175 |
| 772621 | 1284 | 1299 | AACTGCTGCGGTTGTA | 38 | 30551 | 30566 | 1176 |
| 798858 | 1287 | 1302 | GGTAACTGCTGCGGTT | 46 | 30554 | 30569 | 1177 |
| 798859 | 1305 | 1320 | CGGACTTGATGAAGAT | 14 | 30572 | 30587 | 1178 |
| 798860 | 1308 | 1323 | TGGCGGACTTGATGAA | 22 | 30575 | 30590 | 1179 |
| 772628 | 1375 | 1390 | GCCTTGATGGAGAAAC | 33 | 30642 | 30657 | 1180 |
| 798871 | 1378 | 1393 | AAAGCCTTGATGGAGA | 20 | 30645 | 30660 | 1181 |
| 798872 | 1384 | 1399 | TAGTCGAAAGCCTTGA | 2 | 30651 | 30666 | 1182 |
| 798873 | 1400 | 1415 | GCTGTACGCCTTCTCG | 27 | 30667 | 30682 | 1183 |
| 798874 | 1404 | 1419 | GCAGGCTGTACGCCTT | 27 | 30671 | 30686 | 1184 |
| 798875 | 1408 | 1423 | CGCTGCAGGCTGTACG | 58 | 30675 | 30690 | 1185 |
| 798876 | 1411 | 1426 | GGCCGCTGCAGGCTGT | 50 | 30678 | 30693 | 1186 |
| 798877 | 1416 | 1431 | CATTGGGCCGCTGCAG | 24 | 30683 | 30698 | 1187 |
| 772633 | 1419 | 1434 | GGTCATTGGGCCGCTG | 37 | 30686 | 30701 | 1188 |
| 798878 | 1436 | 1451 | CTGCTGCATAAACTCG | 49 | 30703 | 30718 | 1189 |
| 798889 | 1472 | 1487 | CACAAAGCTGATCTGC | 0 | 30739 | 30754 | 1190 |
| 798890 | 1475 | 1490 | CTTCACAAAGCTGATC | 40 | 30742 | 30757 | 1191 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 798891 | 1478 | 1493 | GCCCTTCACAAAGCTG | 58 | 30745 | 30760 | 1192 |
| 798892 | 1483 | 1498 | CCCCAGCCCTTCACAA | 39 | 30750 | 30765 | 1193 |
| 798893 | 1486 | 1501 | TGGCCCCAGCCCTTCA | 77 | 30753 | 30768 | 1194 |
| 798894 | 1491 | 1506 | AGCACTGGCCCCAGCC | 55 | 30758 | 30773 | 1195 |
| 798895 | 1494 | 1509 | TGTAGCACTGGCCCCA | 53 | 30761 | 30776 | 1196 |
| 798896 | 1497 | 1512 | GGGTGTAGCACTGGCC | 46 | 30764 | 30779 | 1197 |
| 798897 | 1500 | 1515 | GGCGGGTGTAGCACTG | 60 | 30767 | 30782 | 1198 |
| 790531 | 1512 | 1527 | TGCTGATGAACTGGCG | 8 | 30779 | 30794 | 1199 |
| 798906 | 1554 | 1569 | GCTACCGGCTGTTGAA | 0 | 30821 | 30836 | 1200 |
| 790533 | 1555 | 1570 | GGCTACCGGCTGTTGA | 16 | 30822 | 30837 | 1201 |
| 798907 | 1557 | 1572 | GCGGCTACCGGCTGTT | 0 | 30824 | 30839 | 1202 |
| 798908 | 1558 | 1573 | CGCGGCTACCGGCTGT | 0 | 30825 | 30840 | 1203 |
| 798909 | 1559 | 1574 | ACGCGGCTACCGGCTG | 42 | 30826 | 30841 | 1204 |
| 798910 | 1560 | 1575 | CACGCGGCTACCGGCT | 42 | 30827 | 30842 | 1205 |
| 798911 | 1561 | 1576 | GCACGCGGCTACCGGC | 0 | 30828 | 30843 | 1206 |
| 798912 | 1564 | 1579 | TCCGCACGCGGCTACC | 22 | 30831 | 30846 | 1207 |
| 798913 | 1567 | 1582 | CCCTCCGCACGCGGCT | 21 | 30834 | 30849 | 1208 |
| 798914 | 1570 | 1585 | GTCCCTCCGCACGCG | 56 | 30837 | 30852 | 1209 |
| 798925 | 1606 | 1621 | AGTAGTTTGAAGTGTG | 0 | 30873 | 30888 | 1210 |
| 798926 | 1609 | 1624 | CAAAGTAGTTTGAAGT | 17 | 30876 | 30891 | 1211 |
| 798927 | 1612 | 1627 | CAGCAAAGTAGTTTGA | 0 | 30879 | 30894 | 1212 |
| 798928 | 1615 | 1630 | TAGCAGCAAAGTAGTT | 6 | 30882 | 30897 | 1213 |
| 798929 | 1618 | 1633 | TATTAGCAGCAAAGTA | 41 | 30885 | 30900 | 1214 |
| 798930 | 1623 | 1638 | GAAAATATTAGCAGCA | 62 | 30890 | 30905 | 1215 |
| 798931 | 1626 | 1641 | GAGGAAAATATTAGCA | 69 | 30893 | 30908 | 1216 |
| 798932 | 1631 | 1646 | CTCAGGAGGAAAATAT | 0 | 30898 | 30913 | 1217 |
| 798933 | 1634 | 1649 | GCACTCAGGAGGAAAA | 52 | 30901 | 30916 | 1218 |
| 798934 | 1638 | 1653 | GCAAGCACTCAGGAGG | 40 | 30905 | 30920 | 1219 |
| 798943 | 1704 | 1719 | CGAGGACGAGAAGAAG | 13 | 30971 | 30986 | 1220 |
| 798944 | 1707 | 1722 | AAACGAGGACGAGAAG | 3 | 30974 | 30989 | 1221 |
| 798945 | 1710 | 1725 | CACAAACGAGGACGAG | 19 | 30977 | 30992 | 1222 |
| 798946 | 1713 | 1728 | GAACACAAACGAGGAC | 4 | 30980 | 30995 | 1223 |
| 798947 | 1716 | 1731 | ACAGAACACAAACGAG | 52 | 30983 | 30998 | 1224 |
| 798948 | 1726 | 1741 | GCGAAACAAAACAGAA | 56 | 30993 | 31008 | 1225 |
| 798949 | 1729 | 1744 | AGAGCGAAACAAAACA | 55 | 30996 | 31011 | 1226 |
| 798950 | 1732 | 1747 | CAAAGAGCGAAACAAA | 0 | 30999 | 31014 | 1227 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798951 | 1735 | 1750 | TCTCAAAGAGCGAAAC | 37 | 31002 | 31017 | 1228 |
| 798952 | 1739 | 1754 | TATTTCTCAAAGAGCG | 61 | 31006 | 31021 | 1229 |
| 798963 | 1777 | 1792 | TTCTTCCAAAAAACC | 13 | 31044 | 31059 | 1230 |
| 798964 | 1780 | 1795 | CCCTTCTTCCAAAAAA | 32 | 31047 | 31062 | 1231 |
| 798965 | 1783 | 1798 | TGCCCCTTCTTCCAAA | 43 | 31050 | 31065 | 1232 |
| 798966 | 1787 | 1802 | TACCTGCCCCTTCTTC | 35 | 31054 | 31069 | 1233 |
| 798967 | 1790 | 1805 | TCATACCTGCCCCTTC | 40 | 31057 | 31072 | 1234 |
| 798968 | 1793 | 1808 | CGATCATACCTGCCCC | 62 | 31060 | 31075 | 1235 |
| 798969 | 1796 | 1811 | TGCCGATCATACCTGC | 48 | 31063 | 31078 | 1236 |
| 798970 | 1799 | 1814 | TCCTGCCGATCATACC | 41 | 31066 | 31081 | 1237 |
| 798971 | 1803 | 1818 | GGTGTCCTGCCGATCA | 53 | 31070 | 31085 | 1238 |
| 798972 | 1809 | 1824 | TATCAGGGTGTCCTGC | 18 | 31076 | 31091 | 1239 |
| 798983 | 1861 | 1876 | CCCCTTCATACACTGT | 0 | 31128 | 31143 | 1240 |
| 798984 | 1864 | 1879 | GCCCCCCTTCATACAC | 64 | 31131 | 31146 | 1241 |
| 798985 | 1868 | 1883 | GACCGCCCCCCTTCAT | 41 | 31135 | 31150 | 1242 |
| 798986 | 1871 | 1886 | GATGACCGCCCCCCTT | 34 | 31138 | 31153 | 1243 |
| 798987 | 1874 | 1889 | AATGATGACCGCCCCC | 84 | 31141 | 31156 | 1244 |
| 798988 | 1877 | 1892 | TGAAATGATGACCGCC | 69 | 31144 | 31159 | 1245 |
| 798989 | 1880 | 1895 | AAGTGAAATGATGACC | 8 | 31147 | 31162 | 1246 |
| 798990 | 1883 | 1898 | GACAAGTGAAATGATG | 39 | 31150 | 31165 | 1247 |
| 798991 | 1886 | 1901 | CCTGACAAGTGAAATG | 23 | 31153 | 31168 | 1248 |
| 798992 | 1889 | 1904 | ACTCCTGACAAGTGAA | 29 | 31156 | 31171 | 1249 |
| 799003 | 1917 | 1932 | ACACAGCCGCACACTC | 0 | 31184 | 31199 | 1250 |
| 799004 | 1921 | 1936 | GCACACACAGCCGCAC | 0 | 31188 | 31203 | 1251 |
| 799005 | 1924 | 1939 | CGTGCACACACAGCCG | 0 | 31191 | 31206 | 1252 |
| 799006 | 1938 | 1953 | CGCTCCTGCACACGCG | 0 | 31205 | 31220 | 1253 |
| 799007 | 1941 | 1956 | TGCCGCTCCTGCACAC | 47 | 31208 | 31223 | 1254 |
| 799008 | 1946 | 1961 | CCATCTGCCGCTCCTG | 60 | 31213 | 31228 | 1255 |
| 799009 | 1949 | 1964 | TCCCCATCTGCCGCTC | 62 | 31216 | 31231 | 1256 |
| 799010 | 1956 | 1971 | CGTTGTCTCCCCATCT | 57 | 31223 | 31238 | 1257 |
| 799011 | 1970 | 1985 | CAAAACAAAGAGCACG | 35 | 31237 | 31252 | 1258 |
| 799012 | 1980 | 1995 | ATAAGAGACACAAAAC | 43 | 31247 | 31262 | 1259 |
| 799023 | 2012 | 2027 | TGGGACTGCAAACCTC | 42 | 31279 | 31294 | 1260 |
| 799024 | 2014 | 2029 | CTTGGGACTGCAAACC | 0 | 31281 | 31296 | 1261 |
| 799025 | 2016 | 2031 | CGCTTGGGACTGCAAA | 10 | 31283 | 31298 | 1262 |
| 799026 | 2017 | 2032 | CCGCTTGGGACTGCAA | 1 | 31284 | 31299 | 1263 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799027 | 2018 | 2033 | ACCGCTTGGGACTGCA | 46 | 31285 | 31300 | 1264 |
| 799028 | 2022 | 2037 | AGACACCGCTTGGGAC | 37 | 31289 | 31304 | 1265 |
| 799029 | 2026 | 2041 | GGAGAGACACCGCTTG | 0 | 31293 | 31308 | 1266 |
| 771576 | 2027 | 2046 | GGGCAGGAGAGACACCGCTT | 50 | 31294 | 31313 | 576 |
| 799030 | 2029 | 2044 | GCAGGAGAGACACCGC | 52 | 31296 | 31311 | 1267 |
| 799031 | 2059 | 2074 | TGCCTCTGCCCCACTG | 46 | 31326 | 31341 | 1268 |
| 799032 | 2065 | 2080 | AGGTACTGCCTCTGCC | 42 | 31332 | 31347 | 1269 |
| 799043 | 2111 | 2126 | AGCCGTGCTCCTGGCA | 0 | 31378 | 31393 | 1270 |
| 799043 | 2111 | 2126 | AGCCGTGCTCCTGGCA | 10 | 31378 | 31393 | 1270 |
| 799044 | 2114 | 2129 | CAGAGCCGTGCTCCTG | 0 | 31381 | 31396 | 1271 |
| 799045 | 2117 | 2132 | GGACAGAGCCGTGCTC | 37 | 31384 | 31399 | 1272 |
| 799046 | 2133 | 2148 | GGCTTTCCCAGGCTGG | 0 | 31400 | 31415 | 1273 |
| 799047 | 2157 | 2172 | TTGATGAGGGAGAGGA | 63 | 31424 | 31439 | 1274 |
| 799048 | 2160 | 2175 | TCCTTGATGAGGGAGA | 60 | 31427 | 31442 | 1275 |
| 799049 | 2167 | 2182 | GCCCGTGTCCTTGATG | 44 | 31434 | 31449 | 1276 |
| 799050 | 2171 | 2186 | ACAGGCCCGTGTCCTT | 36 | 31438 | 31453 | 1277 |
| 799051 | 2174 | 2189 | TGGACAGGCCCGTGTC | 32 | 31441 | 31456 | 1278 |
| 799052 | 2177 | 2192 | CTGTGGACAGGCCCGT | 40 | 31444 | 31459 | 1279 |
| 799063 | 2218 | 2233 | TGGTTCTGGTTCGGCC | 9 | 31485 | 31500 | 1280 |
| 799064 | 2222 | 2237 | TAATTGGTTCTGGTTC | 47 | 31489 | 31504 | 1281 |
| 799065 | 2225 | 2240 | AAATAATTGGTTCTGG | 35 | 31492 | 31507 | 1282 |
| 799066 | 2228 | 2243 | TGAAAATAATTGGTTC | 0 | 31495 | 31510 | 1283 |
| 799067 | 2231 | 2246 | GGATGAAAATAATTGG | 74 | 31498 | 31513 | 1284 |
| 799068 | 2236 | 2251 | GACAAGGATGAAAATA | 49 | 31503 | 31518 | 1285 |
| 799069 | 2240 | 2255 | ATAAGACAAGGATGAA | 18 | 31507 | 31522 | 1286 |
| 799070 | 2245 | 2260 | AGGGAATAAGACAAGG | 67 | 31512 | 31527 | 1287 |
| 799071 | 2248 | 2263 | GGAAGGGAATAAGACA | 44 | 31515 | 31530 | 1288 |
| 799072 | 2251 | 2266 | GCAGGAAGGGAATAAG | 55 | 31518 | 31533 | 1289 |
| 799083 | 2320 | 2335 | GGAAGCCCATCTCAGG | 0 | 31587 | 31602 | 1290 |
| 799084 | 2324 | 2339 | CTTGGGAAGCCCATCT | 0 | 31591 | 31606 | 1291 |
| 799085 | 2327 | 2342 | GCCCTTGGGAAGCCCA | 10 | 31594 | 31609 | 1292 |
| 799086 | 2331 | 2346 | GGCAGCCCTTGGGAAG | 0 | 31598 | 31613 | 1293 |
| 799087 | 2335 | 2350 | CCCCGGCAGCCCTTGG | 69 | 31602 | 31617 | 1294 |
| 799088 | 2339 | 2354 | GCTGCCCCGGCAGCCC | 24 | 31606 | 31621 | 1295 |
| 799089 | 2356 | 2371 | AGCAATACTGTGAGGG | 60 | 31623 | 31638 | 1296 |
| 799090 | 2359 | 2374 | GTGAGCAATACTGTGA | 49 | 31626 | 31641 | 1297 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799091 | 2364 | 2379 | ACTGGGTGAGCAATAC | 42 | 31631 | 31646 | 1298 |
| 799092 | 2367 | 2382 | GGCACTGGGTGAGCAA | 30 | 31634 | 31649 | 1299 |
| 799103 | 2420 | 2435 | CCGGGAAAAACCTGAT | 12 | 31687 | 31702 | 1300 |
| 799104 | 2423 | 2438 | AGTCCGGGAAAAACCT | 40 | 31690 | 31705 | 1301 |
| 799105 | 2426 | 2441 | CTAAGTCCGGGAAAAA | 12 | 31693 | 31708 | 1302 |
| 799106 | 2430 | 2445 | TTTTCTAAGTCCGGGA | 34 | 31697 | 31712 | 1303 |
| 799107 | 2434 | 2449 | CTGGTTTTCTAAGTCC | 51 | 31701 | 31716 | 1304 |
| 799108 | 2439 | 2454 | CTGAGCTGGTTTTCTA | 64 | 31706 | 31721 | 1305 |
| 799109 | 2444 | 2459 | CAGTGCTGAGCTGGTT | 48 | 31711 | 31726 | 1306 |
| 799110 | 2447 | 2462 | AGGCAGTGCTGAGCTG | 33 | 31714 | 31729 | 1307 |
| 799111 | 2450 | 2465 | AGCAGGCAGTGCTGAG | 50 | 31717 | 31732 | 1308 |
| 799112 | 2453 | 2468 | GGGAGCAGGCAGTGCT | 58 | 31720 | 31735 | 1309 |
| 799123 | 2489 | 2504 | CTTGCTGGCCTAATAG | 23 | 31756 | 31771 | 1310 |
| 799124 | 2492 | 2507 | CCGCTTGCTGGCCTAA | 17 | 31759 | 31774 | 1311 |
| 799125 | 2495 | 2510 | TCCCCGCTTGCTGGCC | 62 | 31762 | 31777 | 1312 |
| 799126 | 2499 | 2514 | GACATCCCCGCTTGCT | 4 | 31766 | 31781 | 1313 |
| 799127 | 2502 | 2517 | AGGGACATCCCCGCTT | 67 | 31769 | 31784 | 1314 |
| 799128 | 2505 | 2520 | CCCAGGGACATCCCCG | 63 | 31772 | 31787 | 1315 |
| 799129 | 2508 | 2523 | CCTCCCAGGGACATCC | 37 | 31775 | 31790 | 1316 |
| 799130 | 2511 | 2526 | GTCCCTCCCAGGGACA | 1 | 31778 | 31793 | 1317 |
| 799131 | 2514 | 2529 | CATGTCCCTCCCAGGG | 6 | 31781 | 31796 | 1318 |
| 799132 | 2517 | 2532 | AAGCATGTCCCTCCCA | 38 | 31784 | 31799 | 1319 |
| 799143 | 2562 | 2577 | TGGGTTATGACGGACC | 66 | 31829 | 31844 | 1320 |
| 799144 | 2563 | 2578 | TTGGGTTATGACGGAC | 72 | 31830 | 31845 | 1321 |
| 799145 | 2564 | 2579 | CTTGGGTTATGACGGA | 46 | 31831 | 31846 | 1322 |
| 799146 | 2567 | 2582 | TACCTTGGGTTATGAC | 0 | 31834 | 31849 | 1323 |
| 799147 | 2568 | 2583 | GTACCTTGGGTTATGA | 28 | 31835 | 31850 | 1324 |
| 799148 | 2570 | 2585 | TGGTACCTTGGGTTAT | 29 | 31837 | 31852 | 1325 |
| 799149 | 2573 | 2588 | GGATGGTACCTTGGGT | 46 | 31840 | 31855 | 1326 |
| 799150 | 2576 | 2591 | CTAGGATGGTACCTTG | 22 | 31843 | 31858 | 1327 |
| 799151 | 2579 | 2594 | AGCCTAGGATGGTACC | 39 | 31846 | 31861 | 1328 |
| 799152 | 2583 | 2598 | TGTCAGCCTAGGATGG | 33 | 31850 | 31865 | 1329 |
| 799163 | 2633 | 2648 | AAGTATCATACGAGTG | 45 | 31900 | 31915 | 1330 |
| 799164 | 2636 | 2651 | TCGAAGTATCATACGA | 37 | 31903 | 31918 | 1331 |
| 799165 | 2639 | 2654 | GTGTCGAAGTATCATA | 42 | 31906 | 31921 | 1332 |
| 799166 | 2643 | 2658 | AACAGTGTCGAAGTAT | 21 | 31910 | 31925 | 1333 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799167 | 2646 | 2661 | AAGAACAGTGTCGAAG | 58 | 31913 | 31928 | 1334 |
| 799168 | 2649 | 2664 | GCTAAGAACAGTGTCG | 75 | 31916 | 31931 | 1335 |
| 799169 | 2653 | 2668 | TTGAGCTAAGAACAGT | 0 | 31920 | 31935 | 1336 |
| 799170 | 2656 | 2671 | TCATTGAGCTAAGAAC | 17 | 31923 | 31938 | 1337 |
| 799171 | 2659 | 2674 | TGCTCATTGAGCTAAG | 30 | 31926 | 31941 | 1338 |
| 799172 | 2663 | 2678 | AACATGCTCATTGAGC | 4 | 31930 | 31945 | 1339 |
| 799183 | 2699 | 2714 | CTTTGTAGTTAGAAAA | 0 | 31966 | 31981 | 1340 |
| 799184 | 2702 | 2717 | AACCTTTGTAGTTAGA | 58 | 31969 | 31984 | 1341 |
| 799185 | 2705 | 2720 | TTAAACCTTTGTAGTT | 0 | 31972 | 31987 | 1342 |
| 790613 | 2708 | 2723 | CATTTAAACCTTTGTA | 0 | 31975 | 31990 | 1343 |
| 772689 | 2711 | 2726 | GTTCATTTAAACCTTT | 26 | 31978 | 31993 | 1344 |
| 799186 | 2714 | 2729 | CTTGTTCATTTAAACC | 31 | 31981 | 31996 | 1345 |
| 799187 | 2719 | 2734 | CTTCTCTTGTTCATTT | 17 | 31986 | 32001 | 1346 |
| 799188 | 2721 | 2736 | TGCTTCTCTTGTTCAT | 43 | 31988 | 32003 | 1347 |
| 799189 | 2723 | 2738 | AATGCTTCTCTTGTTC | 33 | 31990 | 32005 | 1348 |
| 799190 | 2725 | 2740 | AGAATGCTTCTCTTGT | 61 | 31992 | 32007 | 1349 |
| 799197 | 2756 | 2771 | CTCAAAGCACTACAAT | 34 | 32023 | 32038 | 1350 |
| 772696 | 2759 | 2774 | TCTCTCAAAGCACTAC | 56 | 32026 | 32041 | 1351 |
| 799198 | 2767 | 2782 | GTCCTTTCTCTCTCAA | 17 | 32034 | 32049 | 1352 |
| 799199 | 2770 | 2785 | GGAGTCCTTTCTCTCT | 24 | 32037 | 32052 | 1353 |
| 799200 | 2773 | 2788 | TCAGGAGTCCTTTCTC | 69 | 32040 | 32055 | 1354 |
| 799201 | 2776 | 2791 | TTTTCAGGAGTCCTTT | 38 | 32043 | 32058 | 1355 |
| 799202 | 2779 | 2794 | TTTTTTTCAGGAGTCC | 33 | 32046 | 32061 | 1356 |
| 799203 | 2782 | 2797 | GGTTTTTTTTCAGGAG | 56 | 32049 | 32064 | 1357 |
| 799204 | 2786 | 2801 | CTCAGGTTTTTTTCA | 36 | 32053 | 32068 | 1358 |
| 799205 | 2791 | 2806 | TAAATCTCAGGTTTTT | 54 | 32058 | 32073 | 1359 |
| 799213 | 2899 | 2914 | TGTTTATACACATTGC | 42 | 32166 | 32181 | 1360 |
| 799214 | 2903 | 2918 | TTCTTGTTTATACACA | 46 | 32170 | 32185 | 1361 |
| 790621 | 2922 | 2937 | GTGCATCTTTTCTTTA | 0 | 32189 | 32204 | 1362 |
| 772708 | 2925 | 2940 | AAAGTGCATCTTTTCT | 0 | 32192 | 32207 | 1363 |
| 799215 | 2928 | 2943 | AGCAAAGTGCATCTTT | 0 | 32195 | 32210 | 1364 |
| 772709 | 2931 | 2946 | TAAAGCAAAGTGCATC | 0 | 32198 | 32213 | 1365 |
| 799216 | 2934 | 2949 | TATTAAAGCAAAGTGC | 49 | 32201 | 32216 | 1366 |
| 790623 | 2941 | 2956 | GCATTTATATTAAAGC | 0 | 32208 | 32223 | 1367 |
| 799217 | 2948 | 2963 | GTTATTTGCATTTATA | 0 | 32215 | 32230 | 1368 |
| 799218 | 2953 | 2968 | CATTTGTTATTTGCAT | 0 | 32220 | 32235 | 1369 |

TABLE 7-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 772712 | 3000 | 3015 | ACCCATAGAAAAAAAC | 0 | 32267 | 32282 | 1370 |
| 799229 | 3003 | 3018 | AACACCCATAGAAAAA | 22 | 32270 | 32285 | 1371 |
| 790626 | 3006 | 3021 | GATAACACCCATAGAA | 0 | 32273 | 32288 | 1372 |
| 799230 | 3009 | 3024 | GGTGATAACACCCATA | 14 | 32276 | 32291 | 1373 |
| 799231 | 3013 | 3028 | GCTAGGTGATAACACC | 8 | 32280 | 32295 | 1374 |
| 799232 | 3016 | 3031 | TCAGCTAGGTGATAAC | 13 | 32283 | 32298 | 1375 |
| 799233 | 3019 | 3034 | CATTCAGCTAGGTGAT | 28 | 32286 | 32301 | 1376 |
| 799234 | 3022 | 3037 | AAACATTCAGCTAGGT | 13 | 32289 | 32304 | 1377 |
| 799235 | 3025 | 3040 | GAAAACATTCAGCTA | 24 | 32292 | 32307 | 1378 |
| 772717 | 3034 | 3049 | ACTCCTTTAGAAAAAC | 28 | 32301 | 32316 | 1379 |
| 798786 | 888 | 903 | ACTCTAGTTCGCAGAG | 11 | N/A | N/A | 1380 |
| 798787 | 891 | 906 | GAGACTCTAGTTCGCA | 20 | N/A | N/A | 1381 |
| 798807 | 1016 | 1031 | ATCTGAAAGCCCCCCA | 64 | N/A | N/A | 1382 |
| 798808 | 1019 | 1034 | GGAATCTGAAAGCCCC | 44 | N/A | N/A | 1383 |
| 798809 | 1022 | 1037 | TTGGGAATCTGAAAGC | 2 | N/A | N/A | 1384 |
| 798810 | 1025 | 1040 | AAGTTGGGAATCTGAA | 0 | N/A | N/A | 1385 |

TABLE 8

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 798664 | 40 | 55 | GGCCTGCGCTCCGGCT | 7 | 1535 | 1550 | 1386 |
| 798665 | 98 | 113 | CAGTCTCCCGGAGGCC | 7 | 1593 | 1608 | 1387 |
| 790458 | 101 | 116 | CGCCAGTCTCCCGGAG | 0 | 1596 | 1611 | 1388 |
| 798666 | 105 | 120 | CATGCGCCAGTCTCCC | 33 | 1600 | 1615 | 1389 |
| 798667 | 108 | 123 | TGGCATGCGCCAGTCT | 21 | 1603 | 1618 | 1390 |
| 798668 | 112 | 127 | TCCGTGGCATGCGCCA | 45 | 1607 | 1622 | 1391 |
| 798669 | 115 | 130 | CGCTCCGTGGCATGCG | 0 | 1610 | 1625 | 1392 |
| 798670 | 132 | 147 | GGCGGCGGCCCGAGGG | 44 | 1627 | 1642 | 1393 |
| 798671 | 135 | 150 | AGCGGCGGCGGCCCGA | 61 | 1630 | 1645 | 1394 |
| 790460 | 138 | 153 | AGGAGCGGCGGCGGCC | 58 | 1633 | 1648 | 1395 |
| 798678 | 214 | 229 | CGCACACCATGAAGAA | 45 | 1709 | 1724 | 1396 |
| 798679 | 217 | 232 | CTCCGCACACCATGAA | 32 | 1712 | 1727 | 1397 |
| 772536 | 220 | 235 | GACCTCCGCACACCAT | 22 | 1715 | 1730 | 1398 |
| 798680 | 223 | 238 | CATGACCTCCGCACAC | 31 | 1718 | 1733 | 1399 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 798681 | 226 | 241 | GAACATGACCTCCGCA | 29 | 1721 | 1736 | 1400 |
| 790464 | 229 | 244 | AGCGAACATGACCTCC | 58 | 1724 | 1739 | 1401 |
| 790465 | 233 | 248 | AAGGAGCGAACATGAC | 54 | 1728 | 1743 | 1402 |
| 798682 | 236 | 251 | GCTAAGGAGCGAACAT | 60 | 1731 | 1746 | 1403 |
| 798683 | 240 | 255 | GCCTGCTAAGGAGCGA | 51 | 1735 | 1750 | 1404 |
| 798684 | 245 | 260 | CGTTTGCCTGCTAAGG | 51 | 1740 | 1755 | 1405 |
| 798693 | 332 | 347 | GCCGGGCGCACGGCTC | 0 | 1827 | 1842 | 1406 |
| 798694 | 341 | 356 | GTCCTCGCCGCCGGGC | 0 | 1836 | 1851 | 1407 |
| 798695 | 356 | 371 | TGCGCCCTCCTCCTCG | 35 | 1851 | 1866 | 1408 |
| 798696 | 362 | 377 | TCCCCCTGCGCCCTCC | 82 | 1857 | 1872 | 1409 |
| 798697 | 365 | 380 | ACCTCCCCCTGCGCCC | 23 | 1860 | 1875 | 1410 |
| 798698 | 382 | 397 | AGCTCGCCTCCTCCTC | 57 | 1877 | 1892 | 1411 |
| 798699 | 385 | 400 | CGCAGCTCGCCTCCTC | 51 | 1880 | 1895 | 1412 |
| 798700 | 388 | 403 | CCCCGCAGCTCGCCTC | 52 | 1883 | 1898 | 1413 |
| 798701 | 393 | 408 | CTTCTCCCCGCAGCTC | 23 | 1888 | 1903 | 1414 |
| 798702 | 396 | 411 | CCCCTTCTCCCCGCAG | 45 | 1891 | 1906 | 1415 |
| 798713 | 431 | 446 | GCCGCCACCGGCCCCA | 45 | 1926 | 1941 | 1416 |
| 798714 | 435 | 450 | GGCCGCCGCCACCGGC | 0 | 1930 | 1945 | 1417 |
| 798715 | 440 | 455 | GCCCGGGCCGCCGCCA | 0 | 1935 | 1950 | 1418 |
| 798716 | 443 | 458 | CCTGCCCGGGCCGCCG | 0 | 1938 | 1953 | 1419 |
| 798717 | 446 | 461 | AGCCCTGCCCGGGCCG | 18 | 1941 | 1956 | 1420 |
| 798718 | 450 | 465 | ATCCAGCCCTGCCCGG | 37 | 1945 | 1960 | 1421 |
| 798719 | 453 | 468 | AGCATCCAGCCCTGCC | 34 | 1948 | 1963 | 1422 |
| 798720 | 456 | 471 | GGCAGCATCCAGCCCT | 25 | 1951 | 1966 | 1423 |
| 798721 | 461 | 476 | GCCCAGGCAGCATCCA | 41 | 1956 | 1971 | 1424 |
| 798722 | 464 | 479 | CTTGCCCAGGCAGCAT | 0 | 1959 | 1974 | 1425 |
| 798733 | 512 | 527 | CGCGGCTGGCGGGTGG | 72 | 2007 | 2022 | 1426 |
| 798734 | 515 | 530 | GCCCGCGGCTGGCGGG | 0 | 2010 | 2025 | 1427 |
| 798735 | 532 | 547 | CCCCCGGCCGCGCCGG | 0 | 2027 | 2042 | 1428 |
| 798736 | 535 | 550 | GCGCCCCGGCCGCGC | 0 | 2030 | 2045 | 1429 |
| 798737 | 548 | 563 | CAGATCCGCCTCGGCG | 2 | 2043 | 2058 | 1430 |
| 798738 | 551 | 566 | CTTCAGATCCGCCTCG | 25 | 2046 | 2061 | 1431 |
| 798739 | 554 | 569 | CGCCTTCAGATCCGCC | 37 | 2049 | 2064 | 1432 |
| 798740 | 574 | 589 | TTGAGCACCGAGTGCG | 56 | 2069 | 2084 | 1433 |
| 790476 | 577 | 592 | TTCTTGAGCACCGAGT | 67 | 2072 | 2087 | 1434 |
| 798741 | 584 | 599 | CTTCAGTTTCTTGAGC | 17 | 2079 | 2094 | 1435 |

TABLE 8-continued

Inhibition of SMAD7 mRNA expression by 3-10-3 cEt
gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 772556 | 655 | 670 | AGCAGGAGGCACGCGG | 43 | 2150 | 2165 | 1436 |
| 790479 | 658 | 673 | GGCAGCAGGAGGCACG | 43 | 2153 | 2168 | 1437 |
| 798751 | 661 | 676 | CCGGGCAGCAGGAGGC | 0 | 2156 | 2171 | 1438 |
| 798752 | 664 | 679 | CGGCCGGGCAGCAGGA | 0 | 2159 | 2174 | 1439 |
| 772557 | 671 | 686 | GTCCAGGCGGCCGGGC | 2 | 2166 | 2181 | 1440 |
| 798753 | 675 | 690 | TGCAGTCCAGGCGGCC | 0 | 2170 | 2185 | 1441 |
| 798754 | 679 | 694 | AGCCTGCAGTCCAGGC | 16 | 2174 | 2189 | 1442 |
| 798755 | 683 | 698 | GCCCAGCCTGCAGTCC | 46 | 2178 | 2193 | 1443 |
| 798756 | 692 | 707 | CGCCCCGGGCCCAGC | 16 | 2187 | 2202 | 1444 |
| 798757 | 714 | 729 | GCGCAGGCTGCGCGCC | 0 | 2209 | 2224 | 1445 |
| 798766 | 763 | 778 | CTGAACACTTTGCACA | 34 | 2258 | 2273 | 1446 |
| 790485 | 766 | 781 | CACCTGAACACTTTGC | 26 | 2261 | 2276 | 1447 |
| 772563 | 769 | 784 | GGCCACCTGAACACTT | 0 | 2264 | 2279 | 1448 |
| 798767 | 772 | 787 | TCCGGCCACCTGAACA | 0 | 2267 | 2282 | 1449 |
| 798768 | 776 | 791 | GAGATCCGGCCACCTG | 42 | 2271 | 2286 | 1450 |
| 798769 | 779 | 794 | CCTGAGATCCGGCCAC | 58 | 2274 | 2289 | 1451 |
| 772565 | 783 | 798 | AATGCCTGAGATCCGG | 64 | 2278 | 2293 | 1452 |
| 798770 | 786 | 801 | AGGAATGCCTGAGATC | 47 | 2281 | 2296 | 1453 |
| 798771 | 789 | 804 | CCGAGGAATGCCTGAG | 62 | 2284 | 2299 | 1454 |
| 798772 | 792 | 807 | CTTCCGAGGAATGCCT | 48 | 2287 | 2302 | 1455 |
| 798781 | 822 | 837 | CGTAAGATTCACAGCA | 52 | 2317 | 2332 | 1456 |
| 790492 | 825 | 840 | TCCCGTAAGATTCACA | 38 | 2320 | 2335 | 1457 |
| 772572 | 829 | 844 | ATCTTCCCGTAAGATT | 0 | 2324 | 2339 | 1458 |
| 790493 | 833 | 848 | GTTGATCTTCCCGTAA | 0 | 2328 | 2343 | 1459 |
| 772573 | 849 | 864 | AGCACACCAGCTCGGG | 57 | 2344 | 2359 | 1460 |
| 798782 | 852 | 867 | TGCAGCACACCAGCTC | 51 | 2347 | 2362 | 1461 |
| 798783 | 871 | 886 | CGGCTAAGGTGATGGG | 45 | 2366 | 2381 | 1462 |
| 798784 | 875 | 890 | GAGTCGGCTAAGGTGA | 35 | 2370 | 2385 | 1463 |
| 790496 | 878 | 893 | GCAGAGTCGGCTAAGG | 42 | 2373 | 2388 | 1464 |
| 790497 | 882 | 897 | GTTCGCAGAGTCGGCT | 23 | 2377 | 2392 | 1465 |
| 799328 | N/A | N/A | ATGCACACTCTCCCAG | 0 | 2510 2532 | 2525 2547 | 1466 |
| 799329 | N/A | N/A | GTATGCACACTCTCCC | 0 | 2512 2534 | 2527 2549 | 1467 |
| 799330 | N/A | N/A | GGTATGCACACTCTCC | 45 | 2513 2535 | 2528 2550 | 1468 |
| 799331 | N/A | N/A | AGGGTATGCACACTCT | 1 | 2515 2537 | 2530 2552 | 1469 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799332 | N/A | N/A | GGGAATGCCCTTTGAG | 45 | 2600 | 2615 | 1470 |
| 799333 | N/A | N/A | AGAAAACCTGGAAGGG | 24 | 2624 | 2639 | 1471 |
| 799334 | N/A | N/A | CCGTAGACCCCTTCGG | 21 | 2651 | 2666 | 1472 |
| 799335 | N/A | N/A | TGCAGGAGCAGTGCCC | 31 | 2665 | 2680 | 1473 |
| 799336 | N/A | N/A | ACTGCAGGAGCAGTGC | 25 | 2667 | 2682 | 1474 |
| 799337 | N/A | N/A | GTCTTTCCGGGTGCGG | 30 | 2759 | 2774 | 1475 |
| 799241 | N/A | N/A | ATTCTCCGTATTTACT | 16 | 2874 | 2889 | 1476 |
| 799252 | N/A | N/A | CAAAGGTGCGCGGCCA | 41 | 2922 | 2937 | 1477 |
| 799253 | N/A | N/A | CTCCAAAGGTGCGCGG | 0 | 2925 | 2940 | 1478 |
| 799254 | N/A | N/A | AAACTCCAAAGGTGCG | 11 | 2928 | 2943 | 1479 |
| 799255 | N/A | N/A | CAAAACTCCAAAGGTG | 0 | 2930 | 2945 | 1480 |
| 799256 | N/A | N/A | CCAAAACTCCAAAGGT | 0 | 2931 | 2946 | 1481 |
| 799257 | N/A | N/A | CCCCAAAACTCCAAAG | 27 | 2933 | 2948 | 1482 |
| 799258 | N/A | N/A | GCCCCAAAACTCCAAA | 4 | 2934 | 2949 | 1483 |
| 799259 | N/A | N/A | TGCCCCAAAACTCCAA | 45 | 2935 | 2950 | 1484 |
| 799260 | N/A | N/A | TTGCCCCAAAACTCCA | 27 | 2936 | 2951 | 1485 |
| 799261 | N/A | N/A | TTTGCCCCAAAACTCC | 52 | 2937 | 2952 | 1486 |
| 799348 | N/A | N/A | ATAAAAGGAAAGGAGT | 21 | 3169 | 3184 | 1487 |
| 799349 | N/A | N/A | AGCGCACTCGGGAGAT | 0 | 3301 | 3316 | 1488 |
| 799349 | N/A | N/A | AGCGCACTCGGGAGAT | 0 | 3301 | 3316 | 1488 |
| 799350 | N/A | N/A | ATTCCTAGCGCACTCG | 31 | 3307 | 3322 | 1489 |
| 799351 | N/A | N/A | TTTAGCTGTCAGATAA | 31 | 3606 | 3621 | 1490 |
| 799352 | N/A | N/A | GCGGTGATTGCCTTGA | 24 | 3624 | 3639 | 1491 |
| 799353 | N/A | N/A | TCTTTTAGCCCAACTG | 45 | 3678 | 3693 | 1492 |
| 799354 | N/A | N/A | ATCTACTCACCAGTTG | 0 | 3818 | 3833 | 1493 |
| 799355 | N/A | N/A | AGGAAACCTAGAACCA | 23 | 3935 | 3950 | 1494 |
| 799356 | N/A | N/A | GAAAAATTCACCAAAC | 23 | 3960 | 3975 | 1495 |
| 799357 | N/A | N/A | CACAACAGAAAAATTC | 41 | 3967 | 3982 | 1496 |
| 799367 | N/A | N/A | AGTCTCCGAGTTATCC | 41 | 4146 | 4161 | 1497 |
| 799368 | N/A | N/A | CTAAGTCTCCGAGTTA | 68 | 4149 | 4164 | 1498 |
| 799369 | N/A | N/A | ACTCACTAAGTCTCCG | 50 | 4154 | 4169 | 1499 |
| 799370 | N/A | N/A | GGCACTCACTAAGTCT | 13 | 4157 | 4172 | 1500 |
| 799371 | N/A | N/A | CCCTTTCCATTATTCC | 28 | 4186 | 4201 | 1501 |
| 799372 | N/A | N/A | CCCATCTATCGAATCA | 67 | 4202 | 4217 | 1502 |
| 799373 | N/A | N/A | AACCGTCTTCCCATCT | 56 | 4211 | 4226 | 1503 |
| 799374 | N/A | N/A | TTGCACCTTTTTAAAC | 30 | 4224 | 4239 | 1504 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 799375 | N/A | N/A | GCCTATACTTCTGAAA | 10 | 4273 | 4288 | 1505 |
| 799376 | N/A | N/A | GCAGGAGGAACCTACC | 45 | 4313 | 4328 | 1506 |
| 799387 | N/A | N/A | CCAGGAGCTAAATGGT | 22 | 4775 | 4790 | 1507 |
| 799388 | N/A | N/A | TTGCAGAATTCCAGGA | 41 | 4785 | 4800 | 1508 |
| 799389 | N/A | N/A | AAAACGCAGGAGGCGG | 27 | 4807 | 4822 | 1509 |
| 799390 | N/A | N/A | CAAAACTTTTAATTAG | 0 | 4845 | 4860 | 1510 |
| 799391 | N/A | N/A | CGCCCCAGCAAAACTT | 0 | 4853 | 4868 | 1511 |
| 799392 | N/A | N/A | TATTAGACCGGCACCA | 46 | 4980 | 4995 | 1512 |
| 799393 | N/A | N/A | TGCTTTGCGGGCCACT | 56 | 4996 | 5011 | 1513 |
| 799394 | N/A | N/A | ACAGAGAGCTGGGTAT | 33 | 5068 | 5083 | 1514 |
| 799395 | N/A | N/A | TTACAAATACAGAGAG | 62 | 5076 | 5091 | 1515 |
| 799396 | N/A | N/A | TGTTACAAATACAGAG | 69 | 5078 | 5093 | 1516 |
| 799407 | N/A | N/A | TGCAGGAAACCCAAGG | 33 | 5358 | 5373 | 1517 |
| 799408 | N/A | N/A | TTAAATCCTGAGAACA | 27 | 5392 | 5407 | 1518 |
| 799409 | N/A | N/A | CTACCTAATGTCAACA | 34 | 5475 | 5490 | 1519 |
| 799410 | N/A | N/A | TCTGTTTACACACATT | 79 | 5494 | 5509 | 1520 |
| 799411 | N/A | N/A | TGGAGAACTTTTCTCC | 0 | 5546 | 5561 | 1521 |
| 790680 | N/A | N/A | GGTGAGTAACCAGCTG | 56 | 5607 | 5622 | 1522 |
| 799412 | N/A | N/A | TTCTTACACAGCAGCG | 60 | 5669 | 5684 | 1523 |
| 799413 | N/A | N/A | ATTACTGATGCTAAAT | 34 | 5684 | 5699 | 1524 |
| 799414 | N/A | N/A | CAAAACCAGCCCCAGA | 34 | 5791 | 5806 | 1525 |
| 799415 | N/A | N/A | GCCACAGCAGCTGGCA | 0 | 5805 | 5820 | 1526 |
| 799426 | N/A | N/A | GCTTAAATTATAGCAA | 7 | 6153 | 6168 | 1527 |
| 799427 | N/A | N/A | GTCCAGGCCTCCCAGA | 20 | 6183 | 6198 | 1528 |
| 799428 | N/A | N/A | GACCACACAGTACCTA | 47 | 6209 | 6224 | 1529 |
| 799429 | N/A | N/A | CACAAGTCACAACTGG | 74 | 6279 | 6294 | 1530 |
| 799430 | N/A | N/A | AGCCACAAGTCACAAC | 29 | 6282 | 6297 | 1531 |
| 800109 | N/A | N/A | ACAGCCACAAGTCACA | 86 | 6284 | 6299 | 783 |
| 799431 | N/A | N/A | GACAGCCACAAGTCAC | 39 | 6285 | 6300 | 1532 |
| 799432 | N/A | N/A | TGACAGCCACAAGTCA | 7 | 6286 | 6301 | 1533 |
| 799433 | N/A | N/A | TTCTTGTGGGATGTGG | 56 | 6326 | 6341 | 1534 |
| 799434 | N/A | N/A | TGAAACACGGGAAGCA | 37 | 6392 | 6407 | 1535 |
| 799435 | N/A | N/A | TCCTCAAACCTTTCAG | 60 | 6422 | 6437 | 1536 |
| 799446 | N/A | N/A | GACCTAATCTCTTTCA | 48 | 6623 | 6638 | 1537 |
| 799447 | N/A | N/A | ATGAATGACCTAATCT | 30 | 6629 | 6644 | 1538 |
| 799448 | N/A | N/A | GTAAAATGAATGACTG | 41 | 6666 | 6681 | 1539 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799449 | N/A | N/A | CAGCACTGCATCGGAA | 37 | 6717 | 6732 | 1540 |
| 799450 | N/A | N/A | AAGAACACAGCACTGC | 53 | 6724 7026 | 6739 7041 | 1541 |
| 799451 | N/A | N/A | AAAGAACACAGCACTG | 41 | 6725 7027 | 6740 7042 | 1542 |
| 799452 | N/A | N/A | AAAAGAACACAGCACT | 44 | 6726 7028 | 6741 7043 | 1543 |
| 799453 | N/A | N/A | ACACAGCACTGCCAGG | 58 | 7022 | 7037 | 1544 |
| 799454 | N/A | N/A | TTAAAGACAGAGGAGC | 55 | 7127 | 7142 | 1545 |
| 799455 | N/A | N/A | TGTTAAAGACAGAGGA | 55 | 7129 | 7144 | 1546 |
| 799466 | N/A | N/A | GACAGAAGCTCTAGGC | 53 | 7368 | 7383 | 1547 |
| 799467 | N/A | N/A | GCAGACAGAAGCTCTA | 69 | 7371 | 7386 | 1548 |
| 799468 | N/A | N/A | TCACCTTAGGCCTGTG | 22 | 7417 | 7432 | 1549 |
| 799469 | N/A | N/A | CTCCGCATAGACAGAT | 69 | 7449 | 7464 | 1550 |
| 799470 | N/A | N/A | AAAAGCTCCGCATAGA | 10 | 7454 | 7469 | 1551 |
| 799471 | N/A | N/A | CACAGAAAAGCTCCGC | 71 | 7459 | 7474 | 1552 |
| 799472 | N/A | N/A | AGCCATACCTCCATCT | 31 | 7481 | 7496 | 1553 |
| 799473 | N/A | N/A | TATCCCATGGCTCTCA | 63 | 7576 | 7591 | 1554 |
| 799474 | N/A | N/A | CAAGAGTCCAGCCCTA | 39 | 7590 | 7605 | 1555 |
| 799475 | N/A | N/A | GTGAGCTGGGCTATTC | 51 | 7607 | 7622 | 1556 |
| 799485 | N/A | N/A | AGCCACTCCCCGCCAC | 0 | 7929 | 7944 | 1557 |
| 799486 | N/A | N/A | CATAATGACTTATCCA | 52 | 7946 | 7961 | 1558 |
| 799487 | N/A | N/A | AAACATAATGACTTAT | 0 | 7949 | 7964 | 1559 |
| 799488 | N/A | N/A | TGGAAGACACCCCCAC | 42 | 7968 | 7983 | 1560 |
| 799489 | N/A | N/A | TCTAAACCATTTTGAT | 0 | 8045 | 8060 | 1561 |
| 799490 | N/A | N/A | TTAAATGGTGTATACC | 0 | 8069 | 8084 | 1562 |
| 799491 | N/A | N/A | GGCAGGCAGGAAATGG | 38 | 8094 | 8109 | 1563 |
| 799492 | N/A | N/A | AAACAATAGAGGCAGG | 58 | 8104 | 8119 | 1564 |
| 799493 | N/A | N/A | ATACACTTAATCAAAC | 1 | 8123 | 8138 | 1565 |
| 799494 | N/A | N/A | AGGATACACTTAATCA | 45 | 8126 | 8141 | 1566 |
| 799505 | N/A | N/A | CCCGGCTAAGGAAAGG | 31 | 8593 | 8608 | 1567 |
| 799506 | N/A | N/A | GGAGAGCCCGGCTAAG | 4 | 8599 | 8614 | 1568 |
| 799507 | N/A | N/A | ACTCATTAGTCCCATG | 34 | 8687 | 8702 | 1569 |
| 799508 | N/A | N/A | GCAATTAAAGCAAAAC | 0 | 8722 | 8737 | 1570 |
| 799509 | N/A | N/A | AGAAACAGTCTCCACA | 57 | 8750 | 8765 | 1571 |
| 799510 | N/A | N/A | GAGAAACAGTCTCCAC | 57 | 8751 | 8766 | 1572 |
| 799511 | N/A | N/A | TAATGACAATTCCAGC | 65 | 8768 | 8783 | 1573 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799512 | N/A | N/A | GTTAATGAGGATAATG | 16 | 8779 | 8794 | 1574 |
| 799513 | N/A | N/A | TACCTTTAGATTGCAT | 66 | 8860 | 8875 | 1575 |
| 799514 | N/A | N/A | TCGGAGTTTCCTCACT | 40 | 8882 | 8897 | 1576 |
| 799524 | N/A | N/A | ATCAAGGGCAGAAGGC | 23 | 9272 | 9287 | 1577 |
| 799525 | N/A | N/A | AGGTTTGGGTTGGACT | 8 | 9318 | 9333 | 1578 |
| 799526 | N/A | N/A | AAGGAGGTTTGGGTTG | 12 | 9322 | 9337 | 1579 |
| 799527 | N/A | N/A | GTCAAAGGAGGTTTGG | 4 | 9326 | 9341 | 1580 |
| 799528 | N/A | N/A | CGGATACCAGGTGGTT | 17 | 9348 | 9363 | 1581 |
| 799529 | N/A | N/A | GAATTTCTCTTGCATT | 27 | 9379 | 9394 | 1582 |
| 799530 | N/A | N/A | GCTCAATGAGACTGGC | 34 | 9397 | 9412 | 1583 |
| 799272 | N/A | N/A | ATTACTCGAGTCAGGC | 55 | 9411 | 9426 | 1584 |
| 799273 | N/A | N/A | ATCATTACTCGAGTCA | 41 | 9414 | 9429 | 1585 |
| 799274 | N/A | N/A | TTAATCATTACTCGAG | 24 | 9417 | 9432 | 1586 |
| 799275 | N/A | N/A | CAGTTAATCATTACTC | 0 | 9420 | 9435 | 1587 |
| 790714 | N/A | N/A | AGCCAGTTAATCATTA | 11 | 9423 | 9438 | 1588 |
| 799276 | N/A | N/A | GGCAGCCAGTTAATCA | 29 | 9426 | 9441 | 1589 |
| 799277 | N/A | N/A | CTCCGGGCAGCCAGTT | 21 | 9431 | 9446 | 1590 |
| 799278 | N/A | N/A | CCCGTCTGGGCTCCGG | 14 | 9441 | 9456 | 1591 |
| 790715 | N/A | N/A | TGTCACCCGTCTGGGC | 16 | 9446 | 9461 | 1592 |
| 799279 | N/A | N/A | ACCTTGTCACCCGTCT | 48 | 9450 | 9465 | 1593 |
| 799289 | N/A | N/A | TATTAATGGTCTGCTC | 61 | 9500 | 9515 | 1594 |
| 799290 | N/A | N/A | GATTATTAATGGTCTG | 16 | 9503 | 9518 | 1595 |
| 799291 | N/A | N/A | GCTGATTATTAATGGT | 0 | 9506 | 9521 | 1596 |
| 799292 | N/A | N/A | TGATGCTGATTATTAA | 19 | 9510 | 9525 | 1597 |
| 799293 | N/A | N/A | CCTTGATGCTGATTAT | 5 | 9513 | 9528 | 1598 |
| 799294 | N/A | N/A | CGCGGCCTTGATGCTG | 13 | 9518 | 9533 | 1599 |
| 799295 | N/A | N/A | GACTCGCGGCCTTGAT | 30 | 9522 | 9537 | 1600 |
| 799296 | N/A | N/A | GCTGACTCGCGGCCTT | 45 | 9525 | 9540 | 1601 |
| 799297 | N/A | N/A | AAAGGCTGACTCGCGG | 62 | 9529 | 9544 | 1602 |
| 799298 | N/A | N/A | CCAAAAGGCTGACTCG | 54 | 9532 | 9547 | 1603 |
| 799309 | N/A | N/A | GCACGCTCTAAACAGC | 42 | 9569 | 9584 | 1604 |
| 799310 | N/A | N/A | TAAGCACGCTCTAAAC | 18 | 9572 | 9587 | 1605 |
| 799311 | N/A | N/A | CTTTAAGCACGCTCTA | 27 | 9575 | 9590 | 1606 |
| 799312 | N/A | N/A | CATCTTTAAGCACGCT | 66 | 9578 | 9593 | 1607 |
| 799313 | N/A | N/A | ATCCATCTTTAAGCAC | 0 | 9581 | 9596 | 1608 |
| 799314 | N/A | N/A | CAAGATCCATCTTTAA | 0 | 9585 | 9600 | 1609 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799315 | N/A | N/A | CACCAAGATCCATCTT | 15 | 9588 | 9603 | 1610 |
| 799316 | N/A | N/A | AAACACCAAGATCCAT | 0 | 9591 | 9606 | 1611 |
| 799317 | N/A | N/A | TAAAACACCAAGATC | 0 | 9594 | 9609 | 1612 |
| 799318 | N/A | N/A | GTGGATTTGAAAAGGG | 58 | 9634 | 9649 | 1613 |
| 799531 | N/A | N/A | CTTTAGCAATTTCAAA | 32 | 9768 | 9783 | 1614 |
| 799532 | N/A | N/A | GCAGAAGGCCACCCCC | 21 | 9795 | 9810 | 1615 |
| 799533 | N/A | N/A | GAATGAAGTCCAGACC | 50 | 9821 | 9836 | 1616 |
| 799544 | N/A | N/A | TTCAACAAGTTCCCTA | 72 | 10129 | 10144 | 1617 |
| 799545 | N/A | N/A | TCCCACCCTGGTGCTC | 9 | 10257 | 10272 | 1618 |
| 799546 | N/A | N/A | TACTGTTGGCAGTGCT | 48 | 10272 | 10287 | 1619 |
| 799547 | N/A | N/A | TCCTACTGTTGGCAGT | 50 | 10275 | 10290 | 1620 |
| 799548 | N/A | N/A | CTCCTACTGTTGGCAG | 39 | 10276 | 10291 | 1621 |
| 799549 | N/A | N/A | GCTCCTACTGTTGGCA | 53 | 10277 | 10292 | 1622 |
| 799550 | N/A | N/A | AGCTCCTACTGTTGGC | 50 | 10278 | 10293 | 1623 |
| 799551 | N/A | N/A | TTACAGCTCCTACTGT | 12 | 10282 | 10297 | 1624 |
| 799552 | N/A | N/A | AGGGAACAATTACAGC | 58 | 10291 | 10306 | 1625 |
| 799553 | N/A | N/A | CCCCGCTAGGGAACAA | 46 | 10298 | 10313 | 1626 |
| 799564 | N/A | N/A | CAGATAACAGAGTATA | 70 | 10876 | 10891 | 1627 |
| 799565 | N/A | N/A | AGTAAACAATACCCTC | 79 | 10897 | 10912 | 1628 |
| 799566 | N/A | N/A | GAGTAAACAATACCCT | 74 | 10898 | 10913 | 1629 |
| 799567 | N/A | N/A | CTTTGAGTAAACAATA | 15 | 10902 | 10917 | 1630 |
| 799568 | N/A | N/A | CATTAGAAGCTTTGAG | 62 | 10911 | 10926 | 1631 |
| 799569 | N/A | N/A | CTCTAGGTCCCTCTTT | 24 | 10942 | 10957 | 1632 |
| 799570 | N/A | N/A | AAAAGATGCAGTTCAC | 39 | 11029 | 11044 | 1633 |
| 799571 | N/A | N/A | CAGAAAAGATGCAGTT | 46 | 11032 | 11047 | 1634 |
| 799572 | N/A | N/A | ACCATCTAACAACATC | 79 | 11125 | 11140 | 1635 |
| 799573 | N/A | N/A | AATAAAACCATCTAAC | 0 | 11131 | 11146 | 1636 |
| 799583 | N/A | N/A | AAGACAAACCTTCCGA | 74 | 11237 | 11252 | 1637 |
| 799584 | N/A | N/A | TATCAAGAAGACAAAC | 39 | 11244 | 11259 | 1638 |
| 799585 | N/A | N/A | AGACAAGATGTTATCA | 34 | 11255 | 11270 | 1639 |
| 799586 | N/A | N/A | GAGGAGGCACTCAGGC | 50 | 11315 | 11330 | 1640 |
| 799587 | N/A | N/A | TTCACAGGTCACATGG | 42 | 11342 | 11357 | 1641 |
| 799588 | N/A | N/A | AAAAAGCCCACCCATC | 44 | 11368 11739 | 11383 11754 | 1642 |
| 799589 | N/A | N/A | AATATCTGTGTCTACA | 65 | 11836 | 11851 | 1643 |
| 799590 | N/A | N/A | CTGCAGTCTTCTGAAG | 9 | 11901 | 11916 | 1644 |
| 799591 | N/A | N/A | ATTAGTAAATCAAGAG | 56 | 11967 | 11982 | 1645 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799592 | N/A | N/A | GGAATTAGTAAATCAA | 47 | 11970 | 11985 | 1646 |
| 799603 | N/A | N/A | GCCCATTATGAATACA | 52 | 12037 | 12052 | 1647 |
| 799604 | N/A | N/A | CATCACCTCCCCTCCA | 0 | 12108 | 12123 | 1648 |
| 799605 | N/A | N/A | CCAATAAAGTTCCCTT | 56 | 12175 | 12190 | 1649 |
| 799606 | N/A | N/A | TTTACAAAACTCTCTG | 50 | 12204 | 12219 | 1650 |
| 799607 | N/A | N/A | CCATTTACAAAACTCT | 71 | 12207 | 12222 | 1651 |
| 799608 | N/A | N/A | ACGATCAACTTCTTGA | 70 | 12246 | 12261 | 1652 |
| 799609 | N/A | N/A | CCCCATGGAACGATCA | 41 | 12255 | 12270 | 1653 |
| 799610 | N/A | N/A | GGGAGAAACTCCTCAG | 45 | 12406 | 12421 | 1654 |
| 799611 | N/A | N/A | TGTGAAAGAGGCTCAG | 37 | 12445 | 12460 | 1655 |
| 799612 | N/A | N/A | AAACAGCACACAGGGC | 50 | 12462 | 12477 | 1656 |
| 799622 | N/A | N/A | TTCTAAAAATGTCCCA | 45 | 12912 | 12927 | 1657 |
| 799623 | N/A | N/A | TACAATCTCCTGGAAG | 45 | 12940 | 12955 | 1658 |
| 799624 | N/A | N/A | TGAAAGTACAATCTCC | 58 | 12946 | 12961 | 1659 |
| 799625 | N/A | N/A | AATGAAAGTACAATCT | 31 | 12948 | 12963 | 1660 |
| 799626 | N/A | N/A | AGCTTGCACCCAGCAA | 41 | 12994 | 13009 | 1661 |
| 799627 | N/A | N/A | CACAAGCTTGCACCCA | 48 | 12998 | 13013 | 1662 |
| 799628 | N/A | N/A | ACACACACAAGCTTGC | 38 | 13003 | 13018 | 1663 |
| 799629 | N/A | N/A | TACACACACAAGCTTG | 24 | 13004 | 13019 | 1664 |
| 799630 | N/A | N/A | CCCTATCCCAGAGCCT | 43 | 13132 | 13147 | 1665 |
| 799631 | N/A | N/A | CCAAATCACAAAGCAG | 82 | 13234 | 13249 | 1666 |
| 799642 | N/A | N/A | GCAAATCCTTTCCATC | 53 | 13412 | 13427 | 1667 |
| 799643 | N/A | N/A | GTGATCCCCGGAAAGC | 26 | 13435 | 13450 | 1668 |
| 799644 | N/A | N/A | TTCCAACACATGCTCT | 31 | 13460 | 13475 | 1669 |
| 799645 | N/A | N/A | CAAAGATGATAGCTTC | 45 | 13473 | 13488 | 1670 |
| 799646 | N/A | N/A | CAGAAACTCCAGATGG | 18 | 13495 | 13510 | 1671 |
| 799647 | N/A | N/A | ACAGAAACTCCAGATG | 0 | 13496 | 13511 | 1672 |
| 799648 | N/A | N/A | ATGAAAGCCCCCAGAC | 9 | 13510 | 13525 | 1673 |
| 799649 | N/A | N/A | AAATGAAAGCCCCCAG | 53 | 13512 | 13527 | 1674 |
| 799650 | N/A | N/A | CAGCAGACAGGCAAAA | 46 | 13525 | 13540 | 1675 |
| 799651 | N/A | N/A | AGGACAGCAGACAGGC | 55 | 13529 | 13544 | 1676 |
| 799662 | N/A | N/A | CGTGAGCACTTCTGTC | 55 | 13778 | 13793 | 1677 |
| 799663 | N/A | N/A | GCACAGCCAAGAGATG | 57 | 13809 | 13824 | 1678 |
| 799664 | N/A | N/A | GCCAGCAAGGATCAAA | 8 | 13989 | 14004 | 1679 |
| 799665 | N/A | N/A | GATGCCAGCAAGGATC | 57 | 13992 | 14007 | 1680 |
| 799666 | N/A | N/A | CAGATGCCAGCAAGGA | 51 | 13994 | 14009 | 1681 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 799667 | N/A | N/A | ACAGATGCCAGCAAGG | 79 | 13995 | 14010 | 1682 |
| 799668 | N/A | N/A | GACAGATGCCAGCAAG | 75 | 13996 | 14011 | 1683 |
| 799669 | N/A | N/A | TATGACAGATGCCAGC | 81 | 13999 | 14014 | 1684 |
| 799670 | N/A | N/A | TCTGAGACTATGACAG | 51 | 14007 | 14022 | 1685 |
| 799671 | N/A | N/A | AGGTATTTTTGAAGGC | 59 | 14028 | 14043 | 1686 |
| 799682 | N/A | N/A | GGTCCAGGACTGGTCT | 55 | 14579 | 14594 | 1687 |
| 799683 | N/A | N/A | CTGCAGAAGAGGCGGG | 32 | 14594 | 14609 | 1688 |
| 799684 | N/A | N/A | AATGCTGTCACCCTGT | 52 | 14703 | 14718 | 1689 |
| 799685 | N/A | N/A | GATTTTAAATGCTGTC | 25 | 14710 | 14725 | 1690 |
| 799686 | N/A | N/A | GAGATTTTAAATGCTG | 62 | 14712 | 14727 | 1691 |
| 799687 | N/A | N/A | GGCAGCAGACCATCTT | 35 | 14761 | 14776 | 1692 |
| 799688 | N/A | N/A | CACCACCCAAAGCCTG | 50 | 14839 | 14854 | 1693 |
| 799689 | N/A | N/A | TGCTACAGTGTCACCA | 63 | 14862 | 14877 | 1694 |
| 799690 | N/A | N/A | AGCTACAGTCAGGCTT | 51 | 14958 | 14973 | 1695 |
| 799691 | N/A | N/A | TCCCATAGGTGTACAA | 49 | 14982 | 14997 | 1696 |
| 799702 | N/A | N/A | CATCACCACTCTACAG | 43 | 15772 | 15787 | 1697 |
| 799703 | N/A | N/A | CCAATGGCATTGAATA | 45 | 15808 | 15823 | 1698 |
| 799704 | N/A | N/A | ACCAATGGCATTGAAT | 12 | 15809 | 15824 | 1699 |
| 799705 | N/A | N/A | AACTTAAAATGTGCCA | 26 | 15824 | 15839 | 1700 |
| 799706 | N/A | N/A | CTTGTGGTAAAATACA | 47 | 15843 | 15858 | 1701 |
| 799707 | N/A | N/A | AAACTTGTGGTAAAAT | 38 | 15846 | 15861 | 1702 |
| 799708 | N/A | N/A | CAAACTTGTGGTAAAA | 60 | 15847 | 15862 | 1703 |
| 799709 | N/A | N/A | TCAAACTTGTGGTAAA | 60 | 15848 | 15863 | 1704 |
| 799710 | N/A | N/A | GTCAAACTTGTGGTAA | 48 | 15849 | 15864 | 1705 |
| 799711 | N/A | N/A | GGTCAAACTTGTGGTA | 60 | 15850 | 15865 | 1706 |
| 799722 | N/A | N/A | GCAGAGTGAGAACAAG | 67 | 16560 | 16575 | 1707 |
| 799723 | N/A | N/A | AGCCAACCCTGGCACC | 0 | 16620 | 16635 | 1708 |
| 799724 | N/A | N/A | AACTTGGGCAAGGACA | 24 | 16692 | 16707 | 1709 |
| 799725 | N/A | N/A | GGCCACTGCAGCCCTA | 0 | 16709 | 16724 | 1710 |
| 799726 | N/A | N/A | GTATCCTTTCACGAGG | 49 | 16762 | 16777 | 1711 |
| 799727 | N/A | N/A | TGACAGTAGGCAGGCA | 22 | 16857 | 16872 | 1712 |
| 799728 | N/A | N/A | CGGAGAGGAAGCCTCT | 37 | 16876 | 16891 | 1713 |
| 799729 | N/A | N/A | TATCTTCCCGCTGAAA | 52 | 16898 | 16913 | 1714 |
| 772842 | N/A | N/A | GTTAATAATATCTTCC | 79 | 16906 | 16921 | 1715 |
| 799730 | N/A | N/A | TAAATTGAGAACTGTG | 60 | 16930 | 16945 | 1716 |
| 799741 | N/A | N/A | AGTTATCACCCTGTTT | 32 | 17269 | 17284 | 1717 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799742 | N/A | N/A | ATATTTCCTGTTAACT | 23 | 17296 | 17311 | 1718 |
| 799743 | N/A | N/A | CTGGAGTTATTCTCAA | 51 | 17346 | 17361 | 1719 |
| 799744 | N/A | N/A | AAAGAAAATGGCCTAC | 1 | 17458 | 17473 | 1720 |
| 799745 | N/A | N/A | GGCAGTTAACATTTCA | 43 | 17551 | 17566 | 1721 |
| 799746 | N/A | N/A | AATGGGAAATAAGGCG | 59 | 17566 | 17581 | 1722 |
| 799747 | N/A | N/A | AAATGGGAAATAAGGC | 43 | 17567 | 17582 | 1723 |
| 799748 | N/A | N/A | GCTGAAAAGTCATGA | 51 | 17597 | 17612 | 1724 |
| 799749 | N/A | N/A | TGCTTGGCCTTACCAT | 17 | 17625 | 17640 | 1725 |
| 799750 | N/A | N/A | AGCCAAGAGCTGCTTG | 0 | 17635 | 17650 | 1726 |
| 799761 | N/A | N/A | TGTCATTAGAACAATG | 35 | 18149 | 18164 | 1727 |
| 799762 | N/A | N/A | GTCCTAAAGACGGCTC | 21 | 18202 | 18217 | 1728 |
| 799763 | N/A | N/A | TGTCCTAAAGACGGCT | 50 | 18203 | 18218 | 1729 |
| 799764 | N/A | N/A | ACGCTAAGGAAAAAGC | 19 | 18290 | 18305 | 1730 |
| 799765 | N/A | N/A | AAGCACGCTAAGGAAA | 23 | 18294 | 18309 | 1731 |
| 799766 | N/A | N/A | AAACAAAGCACGCTAA | 35 | 18299 | 18314 | 1732 |
| 799767 | N/A | N/A | TCTGTTTGGACAAGTT | 47 | 18379 | 18394 | 1733 |
| 799768 | N/A | N/A | CACCAACCTCTGTGGG | 0 | 18434 | 18449 | 1734 |
| 799769 | N/A | N/A | CCACCAACCTCTGTGG | 0 | 18435 | 18450 | 1735 |
| 799770 | N/A | N/A | GTTTCCAAGGCCGGCG | 50 | 18456 | 18471 | 1736 |
| 799781 | N/A | N/A | GTCAATACATATTTGC | 66 | 18710 | 18725 | 1737 |
| 799782 | N/A | N/A | CATAATAGGTGTCAAT | 4 | 18720 | 18735 | 1738 |
| 799783 | N/A | N/A | GCACATAATAGGTGTC | 24 | 18723 | 18738 | 1739 |
| 799784 | N/A | N/A | CAGGAACTGGTCCTCT | 19 | 18756 | 18771 | 1740 |
| 799785 | N/A | N/A | CTCCAGGTAGAGGCAA | 0 | 18872 | 18887 | 1741 |
| 799786 | N/A | N/A | ACAGAAGCTGCCCCTG | 0 | 18893 | 18908 | 1742 |
| 799787 | N/A | N/A | CCAAAGCAGAAGTAGA | 58 | 19007 | 19022 | 1743 |
| 799788 | N/A | N/A | CACAACCAAAGCAGAA | 59 | 19012 | 19027 | 1744 |
| 799789 | N/A | N/A | ACACAACCAAAGCAGA | 44 | 19013 | 19028 | 1745 |
| 799790 | N/A | N/A | GAGACCTACCTCTGTT | 33 | 19068 | 19083 | 1746 |
| 799801 | N/A | N/A | AATCAAGTCCTCTGGA | 18 | 19359 | 19374 | 1747 |
| 799802 | N/A | N/A | CCAGACAGGCCAGGGC | 20 | 19473 | 19488 | 1748 |
| 799803 | N/A | N/A | AGAAGGATGAATGTGA | 10 | 19541 | 19556 | 1749 |
| 799804 | N/A | N/A | ACAGACAGAGAAGGAT | 38 | 19549 | 19564 | 1750 |
| 799805 | N/A | N/A | CGAGAAGAGTAATTCA | 1 | 19613 | 19628 | 1751 |
| 799806 | N/A | N/A | GAGGAGCGAGAAGAGT | 6 | 19619 | 19634 | 1752 |
| 799807 | N/A | N/A | AAATTGGAATTGAGAC | 37 | 19715 | 19730 | 1753 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID: 2 Stop Site | SEQ ID NO. |
|---|---|---|---|---|---|---|---|
| 799808 | N/A | N/A | GCTGAAAGAAAGTCCC | 70 | 19745 | 19760 | 1754 |
| 799809 | N/A | N/A | CAATACTGAAATGAGC | 43 | 19798 | 19813 | 1755 |
| 799810 | N/A | N/A | CTTATTGTTTTTGTTC | 14 | 19851 | 19866 | 1756 |
| 799821 | N/A | N/A | CCCCAGAAAACAGCCC | 17 | 20225 | 20240 | 1757 |
| 799822 | N/A | N/A | CACGATCCTGGGCTCT | 0 | 20242 | 20257 | 1758 |
| 799823 | N/A | N/A | ACAGGAAAGTGGAGGA | 46 | 20362 | 20377 | 1759 |
| 799824 | N/A | N/A | GAAATGGCTCCTGCAA | 9 | 20445 | 20460 | 1760 |
| 799825 | N/A | N/A | GACTTGGCAGCCAAGC | 0 | 20506 | 20521 | 1761 |
| 799826 | N/A | N/A | GATCATTCCCACACCC | 33 | 20560 | 20575 | 1762 |
| 799827 | N/A | N/A | AACTACAACCTTTTTA | 26 | 20629 | 20644 | 1763 |
| 799828 | N/A | N/A | TGCGAGCCAAGAGACA | 54 | 20650 | 20665 | 1764 |
| 799829 | N/A | N/A | GAGTTTGCGAGCCAAG | 75 | 20655 | 20670 | 1765 |
| 799830 | N/A | N/A | GAAGAGTTTGCGAGCC | 55 | 20658 | 20673 | 1766 |
| 799841 | N/A | N/A | AAAGAATGGTGGGTGC | 37 | 21059 | 21074 | 1767 |
| 799842 | N/A | N/A | GAAAGAATGGTGGGTG | 16 | 21060 | 21075 | 1768 |
| 799843 | N/A | N/A | GGAGGAGGCAAATTCA | 42 | 21082 | 21097 | 1769 |
| 799844 | N/A | N/A | AGAGGAGGAGGCAAAT | 11 | 21085 | 21100 | 1770 |
| 799845 | N/A | N/A | GAAGTACCTAGAGGAG | 31 | 21094 | 21109 | 1771 |
| 799846 | N/A | N/A | TCCACTATTCTATGAA | 25 | 21107 | 21122 | 1772 |
| 799847 | N/A | N/A | TTCCACTATTCTATGA | 30 | 21108 | 21123 | 1773 |
| 799848 | N/A | N/A | AGCCGATCACAAAAGG | 59 | 21139 | 21154 | 1774 |
| 799849 | N/A | N/A | ATAAGCCGATCACAAA | 41 | 21142 | 21157 | 1775 |
| 799850 | N/A | N/A | GCAATAAATCAACCAG | 49 | 21263 | 21278 | 1776 |
| 799861 | N/A | N/A | ACCGCATGCGATCGGT | 15 | 21495 | 21510 | 1777 |
| 799862 | N/A | N/A | CCCACCGCATGCGATC | 14 | 21498 | 21513 | 1778 |
| 799863 | N/A | N/A | GGCTCCCCCACCGCAT | 16 | 21504 | 21519 | 1779 |
| 799864 | N/A | N/A | CTCAAGCCCACCCCGG | 42 | 21527 | 21542 | 1780 |
| 799865 | N/A | N/A | GGGACAGACTGTCCCC | 0 | 21580 | 21595 | 1781 |
| 799866 | N/A | N/A | CACCGCGCAGGGACAG | 0 | 21589 | 21604 | 1782 |
| 799867 | N/A | N/A | CTCCAATCTGGCTGGT | 24 | 21635 | 21650 | 1783 |
| 799868 | N/A | N/A | CATAAACATGGGCTCC | 34 | 21663 | 21678 | 1784 |
| 799869 | N/A | N/A | CCATAAACATGGGCTC | 16 | 21664 | 21679 | 1785 |
| 799870 | N/A | N/A | ACCCAGAAGCTGCTGT | 18 | 21757 | 21772 | 1786 |
| 799881 | N/A | N/A | AATAAATTCCAATGCA | 0 | 22163 | 22178 | 1787 |
| 799882 | N/A | N/A | TTTGAACATTTACTGC | 41 | 22188 | 22203 | 1788 |
| 799883 | N/A | N/A | TCTAGAGGGTAGGAAA | 9 | 22318 | 22333 | 1789 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799884 | N/A | N/A | CTCCAGTTTCTAGAGG | 0 | 22326 | 22341 | 1790 |
| 799885 | N/A | N/A | CCCCACAGATCCAACT | 0 | 22345 | 22360 | 1791 |
| 799886 | N/A | N/A | ACCAAGCTACTTTTGC | 25 | 22457 | 22472 | 1792 |
| 799887 | N/A | N/A | CAGGACAGTTTTTCCC | 29 | 22513 | 22528 | 1793 |
| 799888 | N/A | N/A | GGACAAAACCCCTAGA | 22 | 22533 | 22548 | 1794 |
| 799889 | N/A | N/A | AAAGGACAAAACCCC | 45 | 22537 | 22552 | 1795 |
| 799890 | N/A | N/A | CATTAAGCCAATTTTC | 41 | 22554 | 22569 | 1796 |
| 799901 | N/A | N/A | AGTCAAGTCTCTTACC | 31 | 22790 | 22805 | 1797 |
| 799902 | N/A | N/A | GGAAGACACAAGGGCT | 34 | 22854 | 22869 | 1798 |
| 799903 | N/A | N/A | TGCATGGCATTGTCTG | 34 | 22910 | 22925 | 1799 |
| 799904 | N/A | N/A | ACTCAGAGCAGCTCTC | 61 | 22973 | 22988 | 1800 |
| 799905 | N/A | N/A | AGTCGAATCATTTCTC | 53 | 23058 | 23073 | 1801 |
| 799906 | N/A | N/A | CATGCAGTCGAATCAT | 11 | 23063 | 23078 | 1802 |
| 799907 | N/A | N/A | AGTAAAGGGCCTCTCT | 10 | 23096 | 23111 | 1803 |
| 799908 | N/A | N/A | CATAATATTGACAGTA | 41 | 23108 | 23123 | 1804 |
| 799909 | N/A | N/A | ATTCATAATATTGACA | 36 | 23111 | 23126 | 1805 |
| 772889 | N/A | N/A | CTCCATTCATAATATT | 7 | 23115 | 23130 | 1806 |
| 799920 | N/A | N/A | GATGAATGCTCCTAAG | 0 | 23381 | 23396 | 1807 |
| 799921 | N/A | N/A | CTAATTAGTGACTGTG | 75 | 23521 | 23536 | 1808 |
| 799922 | N/A | N/A | ACACTAATTAGTGACT | 15 | 23524 | 23539 | 1809 |
| 799923 | N/A | N/A | GCCTACATATTTCGCA | 15 | 23557 | 23572 | 1810 |
| 799924 | N/A | N/A | CAAGCCTACATATTTC | 22 | 23560 | 23575 | 1811 |
| 799925 | N/A | N/A | CCAAGCCTACATATTT | 10 | 23561 | 23576 | 1812 |
| 799926 | N/A | N/A | CCCAAGCCTACATATT | 17 | 23562 | 23577 | 1813 |
| 799927 | N/A | N/A | TCCCAAGCCTACATAT | 0 | 23563 | 23578 | 1814 |
| 799928 | N/A | N/A | CTCCCAAGCCTACATA | 7 | 23564 | 23579 | 1815 |
| 799929 | N/A | N/A | TGCCCAGGCTTGGTTC | 9 | 23620 | 23635 | 1816 |
| 799940 | N/A | N/A | CTTTGAGGAGCAGGGT | 50 | 23856 | 23871 | 1817 |
| 799941 | N/A | N/A | TTTACTACCTTCCAGA | 44 | 23886 | 23901 | 1818 |
| 799942 | N/A | N/A | AACACTGGTTCCATTT | 0 | 23905 | 23920 | 1819 |
| 799943 | N/A | N/A | TGCCCTCTCAGGGTCT | 0 | 24029 | 24044 | 1820 |
| 799944 | N/A | N/A | CTGCAGCAAGAAGTGG | 5 | 24100 | 24115 | 1821 |
| 799945 | N/A | N/A | AGCTTTTAGAGCTGCG | 5 | 24133 | 24148 | 1822 |
| 799946 | N/A | N/A | TCAGAACACACTTTGG | 2 | 24161 | 24176 | 1823 |
| 799947 | N/A | N/A | TCTAAAGCCACCAAGC | 28 | 24202 | 24217 | 1824 |
| 799948 | N/A | N/A | ATATTGCCTGGTGTGA | 48 | 24234 | 24249 | 1825 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799949 | N/A | N/A | ACTGGCCGAAGTGCAG | 10 | 24270 | 24285 | 1826 |
| 799960 | N/A | N/A | AAACAGGGTTCCCCCA | 8 | 24606 | 24621 | 1827 |
| 799961 | N/A | N/A | CCTAAAACAGGGTTCC | 20 | 24610 | 24625 | 1828 |
| 799962 | N/A | N/A | CCAACCCCAGAGGTGA | 0 | 24700 | 24715 | 1829 |
| 799963 | N/A | N/A | AGCCATGGCAGAACCC | 6 | 24727 | 24742 | 1830 |
| 799964 | N/A | N/A | CCCCTTAGCGCATTCT | 55 | 24743 | 24758 | 1831 |
| 799965 | N/A | N/A | CTCCAGTGAAGTGAGA | 0 | 24853 | 24868 | 1832 |
| 799966 | N/A | N/A | GTGGAAGGCTGACCTG | 35 | 24907 | 24922 | 1833 |
| 799967 | N/A | N/A | GACGATGAATCCTGGC | 72 | 24925 | 24940 | 1834 |
| 799968 | N/A | N/A | CTGCGAGTTAATCAGA | 27 | 24997 | 25012 | 1835 |
| 799969 | N/A | N/A | TTAGAGTGAGTTCCTC | 46 | 25046 | 25061 | 1836 |
| 799980 | N/A | N/A | CCAACGGTTGCCTCAT | 78 | 25440 | 25455 | 1837 |
| 799981 | N/A | N/A | ACCAACGGTTGCCTCA | 14 | 25441 | 25456 | 1838 |
| 799982 | N/A | N/A | CACCACGCCTCGCTAA | 0 | 25497 | 25512 | 1839 |
| 799983 | N/A | N/A | CATCACCACGCCTCGC | 15 | 25500 | 25515 | 1840 |
| 799984 | N/A | N/A | ACATCACCACGCCTCG | 61 | 25501 | 25516 | 1841 |
| 799985 | N/A | N/A | AACATCACCACGCCTC | 53 | 25502 | 25517 | 1842 |
| 799986 | N/A | N/A | AAACATCACCACGCCT | 44 | 25503 | 25518 | 1843 |
| 799987 | N/A | N/A | CAAACATCACCACGCC | 57 | 25504 | 25519 | 1844 |
| 799988 | N/A | N/A | GCGCAAACATCACCAC | 32 | 25507 | 25522 | 1845 |
| 799989 | N/A | N/A | TGCACCTGGCAACCTG | 57 | 25526 | 25541 | 1846 |
| 800000 | N/A | N/A | CATTTAGGAACAAGGG | 37 | 25891 | 25906 | 1847 |
| 800001 | N/A | N/A | CAAGATTCCATTTAGG | 2 | 25899 | 25914 | 1848 |
| 800002 | N/A | N/A | CCCCAAGATTCCATTT | 0 | 25902 | 25917 | 1849 |
| 800003 | N/A | N/A | AGAACACGGGCACGCG | 24 | 25986 | 26001 | 1850 |
| 800004 | N/A | N/A | TTTTAATTTGAAGGCG | 8 | 26134 | 26149 | 1851 |
| 800005 | N/A | N/A | CCGCACCCAGACCCCT | 27 | 26158 | 26173 | 1852 |
| 800006 | N/A | N/A | CAAGGAATTTTCCCCT | 41 | 26470 | 26485 | 1853 |
| 800007 | N/A | N/A | CTCAAGGCCACATTTT | 23 | 26494 | 26509 | 1854 |
| 800008 | N/A | N/A | GAACAGACCAGACCCT | 40 | 26577 | 26592 | 1855 |
| 800009 | N/A | N/A | TGCTCATGAATGAACA | 51 | 26588 | 26603 | 1856 |
| 800019 | N/A | N/A | GGCAAAACTCACAGTC | 61 | 27031 | 27046 | 1857 |
| 800020 | N/A | N/A | AACCTCTGAAGGCAAA | 21 | 27041 | 27056 | 1858 |
| 800021 | N/A | N/A | GGCCTCTCGCTGATAG | 0 | 27059 | 27074 | 1859 |
| 800022 | N/A | N/A | GGAAGAGCCTTGGCCT | 30 | 27070 | 27085 | 1860 |
| 800023 | N/A | N/A | AGGAAGAGCCTTGGCC | 0 | 27071 | 27086 | 1861 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 800024 | N/A | N/A | CAAGGACTAAGGAAGA | 18 | 27080 | 27095 | 1862 |
| 800025 | N/A | N/A | AGTACAAGGACTAAGG | 65 | 27084 | 27099 | 1863 |
| 800026 | N/A | N/A | TCAGTACAAGGACTAA | 50 | 27086 | 27101 | 1864 |
| 800027 | N/A | N/A | CGCTTTGCTCCCAGGG | 0 | 27140 | 27155 | 1865 |
| 800028 | N/A | N/A | CACAGCCCACACGAGT | 10 | 27179 | 27194 | 1866 |
| 800039 | N/A | N/A | GGTTAATGGCCCAGCC | 27 | 27615 | 27630 | 1867 |
| 800040 | N/A | N/A | CGCCAGCAATGTGCTG | 15 | 27666 | 27681 | 1868 |
| 800041 | N/A | N/A | GCCACCTAGGCAAGGG | 0 | 27807 | 27822 | 1869 |
| 800042 | N/A | N/A | TGTCAGCCACCTAGGC | 0 | 27812 | 27827 | 1870 |
| 800043 | N/A | N/A | TGCCAGGCCTGTCAGC | 31 | 27821 | 27836 | 1871 |
| 800044 | N/A | N/A | CCTGAGATCGAGGTGC | 18 | 27842 | 27857 | 1872 |
| 800045 | N/A | N/A | GAGGAGCAAGGGAGTG | 59 | 27871 | 27886 | 1873 |
| 800046 | N/A | N/A | GGCCAACAGGAGGAGG | 42 | 27892 | 27907 | 1874 |
| 800047 | N/A | N/A | ACCCACTGAAACCTGG | 28 | 27912 | 27927 | 1875 |
| 800048 | N/A | N/A | TGGAAAGGAAGACTCG | 64 | 28013 | 28028 | 1876 |
| 800059 | N/A | N/A | AAAACAAGACAGGGAC | 31 | 28327 | 28342 | 1877 |
| 800060 | N/A | N/A | CCCCAAAAGCTCCACA | 5 | 28553 | 28568 | 1878 |
| 800061 | N/A | N/A | CCCAAATGCCTGCCCC | 44 | 28565 | 28580 | 1879 |
| 800062 | N/A | N/A | CCCCAAGCTGGCCTTC | 25 | 28580 | 28595 | 1880 |
| 800063 | N/A | N/A | GCCATACAAATGTGCA | 0 | 28658 | 28673 | 1881 |
| 800064 | N/A | N/A | ATGGAGGTGCCCGTCA | 0 | 28679 | 28694 | 1882 |
| 800065 | N/A | N/A | TTAAGTAGCAGCCAGT | 55 | 28700 | 28715 | 1883 |
| 800066 | N/A | N/A | TGTTTTAAGTAGCAGC | 63 | 28704 | 28719 | 1884 |
| 800067 | N/A | N/A | AGGACCTGGGAACCCA | 51 | 28753 | 28768 | 1885 |
| 800068 | N/A | N/A | ACACTAACTGGCTCCA | 34 | 28786 | 28801 | 1886 |
| 800079 | N/A | N/A | TACCTTAACAAAGCTT | 61 | 29526 | 29541 | 1887 |
| 800080 | N/A | N/A | GGGCTACCTTAACAAA | 14 | 29530 | 29545 | 1888 |
| 800081 | N/A | N/A | CGGTATTAACCCGGGC | 0 | 29542 | 29557 | 1889 |
| 800082 | N/A | N/A | GCAGACCGGTATTAAC | 12 | 29548 | 29563 | 1890 |
| 800083 | N/A | N/A | TGCAGACCGGTATTAA | 11 | 29549 | 29564 | 1891 |
| 800084 | N/A | N/A | GCCAAATCACAACATG | 57 | 29563 | 29578 | 1892 |
| 800085 | N/A | N/A | AGCAGCCCTGTACACA | 37 | 29601 | 29616 | 1893 |
| 800086 | N/A | N/A | AGCAGCAGCCCTGTAC | 40 | 29604 | 29619 | 1894 |
| 800087 | N/A | N/A | TAATAGGAAAACAGTC | 0 | 29630 | 29645 | 1895 |
| 800088 | N/A | N/A | AATGAGGGTGGCTTGG | 54 | 29666 | 29681 | 1896 |
| 800099 | N/A | N/A | TGCAAAGGGACCCTTA | 6 | 29974 | 29989 | 1897 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 800100 | N/A | N/A | TGCAGAGCACAGATGC | 16 | 29987 | 30002 | 1898 |
| 800101 | N/A | N/A | AACAAAGCCTCTTCTC | 0 | 30003 | 30018 | 1899 |
| 800102 | N/A | N/A | ACGAGACAGAAAGAAG | 21 | 30174 | 30189 | 1900 |
| 800103 | N/A | N/A | GGACGAGACAGAAAGA | 4 | 30176 | 30191 | 1901 |
| 800104 | N/A | N/A | AGGACGAGACAGAAAG | 17 | 30177 | 30192 | 1902 |
| 800105 | N/A | N/A | TCCTAGAATGAAGACA | 17 | 30232 | 30247 | 1903 |
| 800106 | N/A | N/A | CAGAGAGGGTTAGTGG | 12 | 30265 | 30280 | 1904 |
| 800107 | N/A | N/A | AATCTAGAAAACACAT | 0 | 30284 | 30299 | 1905 |
| 800108 | N/A | N/A | GGAATCTAGAAAACAC | 12 | 30286 | 30301 | 1906 |
| 798811 | 1031 | 1046 | CAGAAGAAGTTGGGAA | 1 | 30298 | 30313 | 1907 |
| 798812 | 1034 | 1049 | CTCCAGAAGAAGTTGG | 0 | 30301 | 30316 | 1908 |
| 772587 | 1043 | 1058 | ATCCCCAGGCTCCAGA | 39 | 30310 | 30325 | 1909 |
| 798813 | 1046 | 1061 | CCGATCCCCAGGCTCC | 23 | 30313 | 30328 | 1910 |
| 772590 | 1051 | 1066 | TGTGACCGATCCCCAG | 37 | 30318 | 30333 | 1911 |
| 798814 | 1056 | 1071 | ACCAGTGTGACCGATC | 25 | 30323 | 30338 | 1912 |
| 798815 | 1059 | 1074 | CGCACCAGTGTGACCG | 45 | 30326 | 30341 | 1913 |
| 798816 | 1062 | 1077 | CCACGCACCAGTGTGA | 24 | 30329 | 30344 | 1914 |
| 798817 | 1066 | 1081 | GCCACCACGCACCAGT | 26 | 30333 | 30348 | 1915 |
| 798818 | 1069 | 1084 | TATGCCACCACGCACC | 63 | 30336 | 30351 | 1916 |
| 798828 | 1127 | 1142 | ATCCAGAGAGGGCTCC | 18 | 30394 | 30409 | 1917 |
| 798829 | 1130 | 1145 | GATATCCAGAGAGGGC | 0 | 30397 | 30412 | 1918 |
| 798830 | 1133 | 1148 | GAAGATATCCAGAGAG | 17 | 30400 | 30415 | 1919 |
| 798831 | 1136 | 1151 | ATAGAAGATATCCAGA | 0 | 30403 | 30418 | 1920 |
| 798832 | 1139 | 1154 | ATCATAGAAGATATCC | 41 | 30406 | 30421 | 1921 |
| 798833 | 1142 | 1157 | TAGATCATAGAAGATA | 48 | 30409 | 30424 | 1922 |
| 790510 | 1151 | 1166 | CCCCTGAGGTAGATCA | 33 | 30418 | 30433 | 1923 |
| 772606 | 1158 | 1173 | AGCCATTCCCCTGAGG | 41 | 30425 | 30440 | 1924 |
| 798834 | 1161 | 1176 | AAAGCCATTCCCCTG | 55 | 30428 | 30443 | 1925 |
| 772610 | 1164 | 1179 | GGCAAAAGCCATTCCC | 34 | 30431 | 30446 | 1926 |
| 798843 | 1205 | 1220 | CTGCACCAGCTGACTC | 37 | 30472 | 30487 | 1927 |
| 798844 | 1210 | 1225 | ACCTTCTGCACCAGCT | 30 | 30477 | 30492 | 1928 |
| 798845 | 1213 | 1228 | CGCACCTTCTGCACCA | 18 | 30480 | 30495 | 1929 |
| 798846 | 1216 | 1231 | CTCCGCACCTTCTGCA | 40 | 30483 | 30498 | 1930 |
| 798847 | 1219 | 1234 | TTGCTCCGCACCTTCT | 24 | 30486 | 30501 | 1931 |
| 798848 | 1223 | 1238 | GATTTTGCTCCGCACC | 40 | 30490 | 30505 | 1932 |
| 798849 | 1228 | 1243 | CAGCCGATTTTGCTCC | 21 | 30495 | 30510 | 1933 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798850 | 1241 | 1256 | CAGCTGGATGCCGCAG | 12 | 30508 | 30523 | 1934 |
| 790515 | 1244 | 1259 | CGTCAGCTGGATGCCG | 26 | 30511 | 30526 | 1935 |
| 798851 | 1259 | 1274 | ACCATCCACCTCCCGC | 21 | 30526 | 30541 | 1936 |
| 798861 | 1311 | 1326 | GTGTGGCGGACTTGAT | 24 | 30578 | 30593 | 1937 |
| 798862 | 1315 | 1330 | TCCAGTGTGGCGGACT | 20 | 30582 | 30597 | 1938 |
| 798863 | 1321 | 1336 | GGGTTGTCCAGTGTGG | 41 | 30588 | 30603 | 1939 |
| 798864 | 1325 | 1340 | GTCCGGGTTGTCCAGT | 33 | 30592 | 30607 | 1940 |
| 798865 | 1328 | 1343 | GGAGTCCGGGTTGTCC | 8 | 30595 | 30610 | 1941 |
| 798866 | 1333 | 1348 | GTCCTGGAGTCCGGGT | 20 | 30600 | 30615 | 1942 |
| 798867 | 1348 | 1363 | TTGTGTACCAACAGCG | 29 | 30615 | 30630 | 1943 |
| 798868 | 1351 | 1366 | ACCTTGTGTACCAACA | 48 | 30618 | 30633 | 1944 |
| 798869 | 1354 | 1369 | AACACCTTGTGTACCA | 41 | 30621 | 30636 | 1945 |
| 798870 | 1357 | 1372 | GGGAACACCTTGTGTA | 14 | 30624 | 30639 | 1946 |
| 798879 | 1440 | 1455 | ACGGCTGCTGCATAAA | 57 | 30707 | 30722 | 1947 |
| 798880 | 1443 | 1458 | TCCACGGCTGCTGCAT | 37 | 30710 | 30725 | 1948 |
| 798881 | 1446 | 1461 | CCGTCCACGGCTGCTG | 14 | 30713 | 30728 | 1949 |
| 798882 | 1449 | 1464 | AGCCCGTCCACGGCTG | 0 | 30716 | 30731 | 1950 |
| 798883 | 1452 | 1467 | TAAAGCCCGTCCACGG | 0 | 30719 | 30734 | 1951 |
| 798884 | 1455 | 1470 | CGGTAAAGCCCGTCCA | 15 | 30722 | 30737 | 1952 |
| 798885 | 1458 | 1473 | GCACGGTAAAGCCCGT | 43 | 30725 | 30740 | 1953 |
| 798886 | 1461 | 1476 | TCTGCACGGTAAAGCC | 29 | 30728 | 30743 | 1954 |
| 798887 | 1465 | 1480 | CTGATCTGCACGGTAA | 26 | 30732 | 30747 | 1955 |
| 798888 | 1469 | 1484 | AAAGCTGATCTGCACG | 40 | 30736 | 30751 | 1956 |
| 798898 | 1515 | 1530 | AGCTGCTGATGAACTG | 2 | 30782 | 30797 | 1957 |
| 798899 | 1518 | 1533 | GGCAGCTGCTGATGAA | 13 | 30785 | 30800 | 1958 |
| 790532 | 1523 | 1538 | GCACGGGCAGCTGCTG | 0 | 30790 | 30805 | 1959 |
| 798900 | 1526 | 1541 | CCAGCACGGGCAGCTG | 0 | 30793 | 30808 | 1960 |
| 798901 | 1533 | 1548 | CCTCTAGCCAGCACGG | 30 | 30800 | 30815 | 1961 |
| 798902 | 1536 | 1551 | TGACCTCTAGCCAGCA | 54 | 30803 | 30818 | 1962 |
| 798903 | 1540 | 1555 | AAGATGACCTCTAGCC | 48 | 30807 | 30822 | 1963 |
| 798904 | 1543 | 1558 | TTGAAGATGACCTCTA | 23 | 30810 | 30825 | 1964 |
| 798905 | 1548 | 1563 | GGCTGTTGAAGATGAC | 35 | 30815 | 30830 | 1965 |
| 772642 | 1552 | 1567 | TACCGGCTGTTGAAGA | 0 | 30819 | 30834 | 1966 |
| 798915 | 1573 | 1588 | TCTGTCCCTCCGCAC | 7 | 30840 | 30855 | 1967 |
| 798916 | 1576 | 1591 | CGCTCTGTCCCCTCCG | 13 | 30843 | 30858 | 1968 |
| 798917 | 1581 | 1596 | GCTCACGCTCTGTCCC | 0 | 30848 | 30863 | 1969 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798918 | 1584 | 1599 | TCAGCTCACGCTCTGT | 44 | 30851 | 30866 | 1970 |
| 798919 | 1587 | 1602 | TGCTCAGCTCACGCTC | 45 | 30854 | 30869 | 1971 |
| 798920 | 1590 | 1605 | GCCTGCTCAGCTCACG | 58 | 30857 | 30872 | 1972 |
| 798921 | 1591 | 1606 | GGCCTGCTCAGCTCAC | 42 | 30858 | 30873 | 1973 |
| 798922 | 1597 | 1612 | AAGTGTGGCCTGCTCA | 59 | 30864 | 30879 | 1974 |
| 798923 | 1600 | 1615 | TTGAAGTGTGGCCTGC | 54 | 30867 | 30882 | 1975 |
| 798924 | 1603 | 1618 | AGTTTGAAGTGTGGCC | 43 | 30870 | 30885 | 1976 |
| 798935 | 1641 | 1656 | AAAGCAAGCACTCAGG | 48 | 30908 | 30923 | 1977 |
| 790543 | 1644 | 1659 | TGAAAAGCAAGCACTC | 23 | 30911 | 30926 | 1978 |
| 798936 | 1647 | 1662 | GCATGAAAAGCAAGCA | 14 | 30914 | 30929 | 1979 |
| 798937 | 1651 | 1666 | GTTTGCATGAAAAGCA | 35 | 30918 | 30933 | 1980 |
| 790545 | 1656 | 1671 | AAAGAGTTTGCATGAA | 24 | 30923 | 30938 | 1981 |
| 798938 | 1659 | 1674 | ACCAAAGAGTTTGCAT | 15 | 30926 | 30941 | 1982 |
| 798939 | 1662 | 1677 | ACGACCAAAGAGTTTG | 46 | 30929 | 30944 | 1983 |
| 798940 | 1665 | 1680 | AAAACGACCAAAGAGT | 29 | 30932 | 30947 | 1984 |
| 798941 | 1668 | 1683 | AAAAAAACGACCAAAG | 40 | 30935 | 30950 | 1985 |
| 798942 | 1698 | 1713 | CGAGAAGAAGAAAACC | 35 | 30965 | 30980 | 1986 |
| 798953 | 1742 | 1757 | AGCTATTTCTCAAAGA | 17 | 31009 | 31024 | 1987 |
| 798954 | 1745 | 1760 | ATAAGCTATTTCTCAA | 54 | 31012 | 31027 | 1988 |
| 798955 | 1748 | 1763 | TTCATAAGCTATTTCT | 15 | 31015 | 31030 | 1989 |
| 798956 | 1751 | 1766 | CTTTTCATAAGCTATT | 22 | 31018 | 31033 | 1990 |
| 798957 | 1754 | 1769 | ATTCTTTTCATAAGCT | 28 | 31021 | 31036 | 1991 |
| 798958 | 1758 | 1773 | AACAATTCTTTTCATA | 0 | 31025 | 31040 | 1992 |
| 798959 | 1761 | 1776 | CCCAACAATTCTTTTC | 36 | 31028 | 31043 | 1993 |
| 798960 | 1764 | 1779 | ACCCCCAACAATTCTT | 39 | 31031 | 31046 | 1994 |
| 798961 | 1767 | 1782 | AAAACCCCCAACAATT | 0 | 31034 | 31049 | 1995 |
| 798962 | 1774 | 1789 | TTCCAAAAAAACCCCC | 2 | 31041 | 31056 | 1996 |
| 798973 | 1812 | 1827 | TCCTATCAGGGTGTCC | 30 | 31079 | 31094 | 1997 |
| 798974 | 1816 | 1831 | CTCTTCCTATCAGGGT | 12 | 31083 | 31098 | 1998 |
| 798975 | 1820 | 1835 | TCCCCTCTTCCTATCA | 47 | 31087 | 31102 | 1999 |
| 798976 | 1832 | 1847 | TGGATTTCTGCTTCCC | 19 | 31099 | 31114 | 2000 |
| 798977 | 1836 | 1851 | TGCTTGGATTTCTGCT | 43 | 31103 | 31118 | 2001 |
| 798978 | 1844 | 1859 | TTTGGTGGTGCTTGGA | 25 | 31111 | 31126 | 2002 |
| 798979 | 1847 | 1862 | GTGTTTGGTGGTGCTT | 19 | 31114 | 31129 | 2003 |
| 798980 | 1852 | 1867 | ACACTGTGTTTGGTGG | 50 | 31119 | 31134 | 2004 |
| 798981 | 1855 | 1870 | CATACACTGTGTTTGG | 58 | 31122 | 31137 | 2005 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 798982 | 1858 | 1873 | CTTCATACACTGTGTT | 45 | 31125 | 31140 | 2006 |
| 798993 | 1892 | 1907 | CACACTCCTGACAAGT | 37 | 31159 | 31174 | 2007 |
| 798994 | 1895 | 1910 | ACACACACTCCTGACA | 0 | 31162 | 31177 | 2008 |
| 798995 | 1905 | 1920 | ACTCACACTCACACAC | 0 | 31172 | 31187 | 2009 |
| 798996 | 1908 | 1923 | CACACTCACACTCACA | 49 | 31175 | 31190 | 2010 |
| 798997 | 1909 | 1924 | GCACACTCACACTCAC | 12 | 31176 | 31191 | 2011 |
| 798998 | 1910 | 1925 | CGCACACTCACACTCA | 13 | 31177 | 31192 | 2012 |
| 798999 | 1911 | 1926 | CCGCACACTCACACTC | 17 | 31178 | 31193 | 2013 |
| 799000 | 1912 | 1927 | GCCGCACACTCACACT | 42 | 31179 | 31194 | 2014 |
| 799001 | 1914 | 1929 | CAGCCGCACACTCACA | 37 | 31181 | 31196 | 2015 |
| 799002 | 1915 | 1930 | ACAGCCGCACACTCAC | 15 | 31182 | 31197 | 2016 |
| 799013 | 1983 | 1998 | TCCATAAGAGACACAA | 37 | 31250 | 31265 | 2017 |
| 799014 | 1986 | 2001 | ACATCCATAAGAGACA | 29 | 31253 | 31268 | 2018 |
| 799015 | 1989 | 2004 | GGGACATCCATAAGAG | 25 | 31256 | 31271 | 2019 |
| 799016 | 2004 | 2019 | CAAACCTCTCTGCTGG | 30 | 31271 | 31286 | 2020 |
| 799017 | 2006 | 2021 | TGCAAACCTCTCTGCT | 0 | 31273 | 31288 | 2021 |
| 799018 | 2007 | 2022 | CTGCAAACCTCTCTGC | 29 | 31274 | 31289 | 2022 |
| 799019 | 2008 | 2023 | ACTGCAAACCTCTCTG | 36 | 31275 | 31290 | 2023 |
| 799020 | 2009 | 2024 | GACTGCAAACCTCTCT | 48 | 31276 | 31291 | 2024 |
| 799021 | 2010 | 2025 | GGACTGCAAACCTCTC | 62 | 31277 | 31292 | 2025 |
| 799022 | 2011 | 2026 | GGGACTGCAAACCTCT | 61 | 31278 | 31293 | 2026 |
| 771576 | 2027 | 2046 | GGGCAGGAGAGACACCGCTT | 49 | 31294 | 31313 | 576 |
| 799033 | 2068 | 2083 | CCCAGGTACTGCCTCT | 35 | 31335 | 31350 | 2027 |
| 799034 | 2072 | 2087 | CTTGCCCAGGTACTGC | 12 | 31339 | 31354 | 2028 |
| 799035 | 2078 | 2093 | CGCCAGCTTGCCCAGG | 0 | 31345 | 31360 | 2029 |
| 799036 | 2081 | 2096 | AGCCGCCAGCTTGCCC | 8 | 31348 | 31363 | 2030 |
| 799037 | 2085 | 2100 | CCCCAGCCGCCAGCTT | 9 | 31352 | 31367 | 2031 |
| 799038 | 2088 | 2103 | GGACCCCAGCCGCCAG | 19 | 31355 | 31370 | 2032 |
| 799039 | 2093 | 2108 | TGCTGGGACCCCAGCC | 19 | 31360 | 31375 | 2033 |
| 799040 | 2096 | 2111 | AGCTGCTGGGACCCCA | 51 | 31363 | 31378 | 2034 |
| 799041 | 2099 | 2114 | GGCAGCTGCTGGGACC | 22 | 31366 | 31381 | 2035 |
| 799042 | 2106 | 2121 | TGCTCCTGGCAGCTGC | 33 | 31373 | 31388 | 2036 |
| 799053 | 2180 | 2195 | AGCCTGTGGACAGGCC | 0 | 31447 | 31462 | 2037 |
| 799054 | 2184 | 2199 | CAGAAGCCTGTGGACA | 15 | 31451 | 31466 | 2038 |
| 799055 | 2187 | 2202 | GCTCAGAAGCCTGTGG | 19 | 31454 | 31469 | 2039 |
| 799056 | 2191 | 2206 | CGCTGCTCAGAAGCCT | 28 | 31458 | 31473 | 2040 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799057 | 2195 | 2210 | GGCTCGCTGCTCAGAA | 0 | 31462 | 31477 | 2041 |
| 799058 | 2199 | 2214 | AGCAGGCTCGCTGCTC | 0 | 31466 | 31481 | 2042 |
| 799059 | 2202 | 2217 | ACTAGCAGGCTCGCTG | 18 | 31469 | 31484 | 2043 |
| 799060 | 2205 | 2220 | GCCACTAGCAGGCTCG | 37 | 31472 | 31487 | 2044 |
| 799061 | 2209 | 2224 | TTCGGCCACTAGCAGG | 45 | 31476 | 31491 | 2045 |
| 799062 | 2213 | 2228 | CTGGTTCGGCCACTAG | 45 | 31480 | 31495 | 2046 |
| 799073 | 2271 | 2286 | CGCTACAATGGCAGGG | 34 | 31538 | 31553 | 2047 |
| 799074 | 2284 | 2299 | CAAAAAGAAAGACGC | 9 | 31551 | 31566 | 2048 |
| 799075 | 2291 | 2306 | AGATGGCCAAAAAGA | 0 | 31558 | 31573 | 2049 |
| 799076 | 2294 | 2309 | AGCAGATGGCCAAAAA | 34 | 31561 | 31576 | 2050 |
| 799077 | 2298 | 2313 | CAGGAGCAGATGGCCA | 28 | 31565 | 31580 | 2051 |
| 799078 | 2301 | 2316 | ATCCAGGAGCAGATGG | 19 | 31568 | 31583 | 2052 |
| 799079 | 2304 | 2319 | GAGATCCAGGAGCAGA | 46 | 31571 | 31586 | 2053 |
| 799080 | 2307 | 2322 | AGGGAGATCCAGGAGC | 56 | 31574 | 31589 | 2054 |
| 799081 | 2311 | 2326 | TCTCAGGGAGATCCAG | 28 | 31578 | 31593 | 2055 |
| 799082 | 2316 | 2331 | GCCCATCTCAGGGAGA | 27 | 31583 | 31598 | 2056 |
| 799093 | 2404 | 2419 | GTCACCAGGGCAGGCA | 47 | 31671 | 31686 | 2057 |
| 799094 | 2408 | 2423 | TGATGTCACCAGGGCA | 57 | 31675 | 31690 | 2058 |
| 799095 | 2411 | 2426 | ACCTGATGTCACCAGG | 0 | 31678 | 31693 | 2059 |
| 799096 | 2412 | 2427 | AACCTGATGTCACCAG | 30 | 31679 | 31694 | 2060 |
| 799097 | 2413 | 2428 | AAACCTGATGTCACCA | 39 | 31680 | 31695 | 2061 |
| 799098 | 2414 | 2429 | AAAACCTGATGTCACC | 38 | 31681 | 31696 | 2062 |
| 799099 | 2415 | 2430 | AAAAACCTGATGTCAC | 44 | 31682 | 31697 | 2063 |
| 799100 | 2416 | 2431 | GAAAAACCTGATGTCA | 38 | 31683 | 31698 | 2064 |
| 799101 | 2417 | 2432 | GGAAAAACCTGATGTC | 55 | 31684 | 31699 | 2065 |
| 799102 | 2419 | 2434 | CGGGAAAAACCTGATG | 34 | 31686 | 31701 | 2066 |
| 799113 | 2456 | 2471 | GATGGGAGCAGGCAGT | 57 | 31723 | 31738 | 2067 |
| 799114 | 2459 | 2474 | CAGGATGGGAGCAGGC | 35 | 31726 | 31741 | 2068 |
| 799115 | 2462 | 2477 | ACACAGGATGGGAGCA | 40 | 31729 | 31744 | 2069 |
| 799116 | 2466 | 2481 | TAACACACAGGATGGG | 34 | 31733 | 31748 | 2070 |
| 799117 | 2469 | 2484 | GCTTAACACACAGGAT | 46 | 31736 | 31751 | 2071 |
| 799118 | 2472 | 2487 | AGAGCTTAACACACAG | 71 | 31739 | 31754 | 2072 |
| 799119 | 2475 | 2490 | AGCAGAGCTTAACACA | 50 | 31742 | 31757 | 2073 |
| 799120 | 2478 | 2493 | AATAGCAGAGCTTAAC | 45 | 31745 | 31760 | 2074 |
| 799121 | 2481 | 2496 | CCTAATAGCAGAGCTT | 25 | 31748 | 31763 | 2075 |
| 799122 | 2485 | 2500 | CTGGCCTAATAGCAGA | 29 | 31752 | 31767 | 2076 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799133 | 2520 | 2535 | GCTAAGCATGTCCCTC | 17 | 31787 | 31802 | 2077 |
| 799134 | 2523 | 2538 | ACTGCTAAGCATGTCC | 17 | 31790 | 31805 | 2078 |
| 799135 | 2526 | 2541 | GGGACTGCTAAGCATG | 38 | 31793 | 31808 | 2079 |
| 799136 | 2541 | 2556 | CTTCTTGGAGGGAAGG | 3 | 31808 | 31823 | 2080 |
| 799137 | 2545 | 2560 | AATCCTTCTTGGAGGG | 49 | 31812 | 31827 | 2081 |
| 799138 | 2548 | 2563 | CCAAATCCTTCTTGGA | 7 | 31815 | 31830 | 2082 |
| 799139 | 2552 | 2567 | CGGACCAAATCCTTCT | 56 | 31819 | 31834 | 2083 |
| 799140 | 2555 | 2570 | TGACGGACCAAATCCT | 60 | 31822 | 31837 | 2084 |
| 799141 | 2558 | 2573 | TTATGACGGACCAAAT | 47 | 31825 | 31840 | 2085 |
| 799142 | 2561 | 2576 | GGGTTATGACGGACCA | 38 | 31828 | 31843 | 2086 |
| 799153 | 2589 | 2604 | GTTAGGTGTCAGCCTA | 68 | 31856 | 31871 | 2087 |
| 799154 | 2592 | 2607 | AGAGTTAGGTGTCAGC | 39 | 31859 | 31874 | 2088 |
| 799155 | 2595 | 2610 | AGAAGAGTTAGGTGTC | 32 | 31862 | 31877 | 2089 |
| 799156 | 2598 | 2613 | GAAAGAAGAGTTAGGT | 37 | 31865 | 31880 | 2090 |
| 799157 | 2612 | 2627 | GTTGTAGAAGAAATGA | 39 | 31879 | 31894 | 2091 |
| 799158 | 2617 | 2632 | TATGAGTTGTAGAAGA | 33 | 31884 | 31899 | 2092 |
| 799159 | 2620 | 2635 | GTGTATGAGTTGTAGA | 56 | 31887 | 31902 | 2093 |
| 799160 | 2624 | 2639 | ACGAGTGTATGAGTTG | 61 | 31891 | 31906 | 2094 |
| 799161 | 2627 | 2642 | CATACGAGTGTATGAG | 29 | 31894 | 31909 | 2095 |
| 799162 | 2630 | 2645 | TATCATACGAGTGTAT | 36 | 31897 | 31912 | 2096 |
| 799173 | 2666 | 2681 | CTAAACATGCTCATTG | 18 | 31933 | 31948 | 2097 |
| 799174 | 2669 | 2684 | AGTCTAAACATGCTCA | 42 | 31936 | 31951 | 2098 |
| 799175 | 2672 | 2687 | TAAAGTCTAAACATGC | 0 | 31939 | 31954 | 2099 |
| 799176 | 2675 | 2690 | TGTTAAAGTCTAAACA | 0 | 31942 | 31957 | 2100 |
| 799177 | 2678 | 2693 | TTATGTTAAAGTCTAA | 0 | 31945 | 31960 | 2101 |
| 799178 | 2681 | 2696 | AGCTTATGTTAAAGTC | 34 | 31948 | 31963 | 2102 |
| 799179 | 2684 | 2699 | AATAGCTTATGTTAAA | 0 | 31951 | 31966 | 2103 |
| 799180 | 2688 | 2703 | GAAAATAGCTTATGT | 20 | 31955 | 31970 | 2104 |
| 799181 | 2692 | 2707 | GTTAGAAAATAGCTT | 37 | 31959 | 31974 | 2105 |
| 799182 | 2695 | 2710 | GTAGTTAGAAAATAG | 20 | 31962 | 31977 | 2106 |
| 790614 | 2726 | 2741 | GAGAATGCTTCTCTTG | 70 | 31993 | 32008 | 2107 |
| 799191 | 2728 | 2743 | ATGAGAATGCTTCTCT | 26 | 31995 | 32010 | 2108 |
| 790615 | 2731 | 2746 | CCAATGAGAATGCTTC | 38 | 31998 | 32013 | 2109 |
| 799192 | 2734 | 2749 | TTTCCAATGAGAATGC | 60 | 32001 | 32016 | 2110 |
| 799193 | 2738 | 2753 | TAAATTTCCAATGAGA | 43 | 32005 | 32020 | 2111 |
| 799194 | 2741 | 2756 | TGCTAAATTTCCAATG | 42 | 32008 | 32023 | 2112 |

TABLE 8-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 799195 | 2744 | 2759 | CAATGCTAAATTTCCA | 43 | 32011 | 32026 | 2113 |
| 790617 | 2747 | 2762 | CTACAATGCTAAATTT | 0 | 32014 | 32029 | 2114 |
| 799196 | 2750 | 2765 | GCACTACAATGCTAAA | 47 | 32017 | 32032 | 2115 |
| 772692 | 2753 | 2768 | AAAGCACTACAATGCT | 19 | 32020 | 32035 | 2116 |
| 790620 | 2794 | 2809 | TAATAAATCTCAGGTT | 30 | 32061 | 32076 | 2117 |
| 772700 | 2797 | 2812 | CTTTAATAAATCTCAG | 24 | 32064 | 32079 | 2118 |
| 799206 | 2848 | 2863 | TATATTTACAAGTAAT | 0 | 32115 | 32130 | 2119 |
| 799207 | 2851 | 2866 | CTTTATATTTACAAGT | 0 | 32118 | 32133 | 2120 |
| 772702 | 2854 | 2869 | CGTCTTTATATTTACA | 23 | 32121 | 32136 | 2121 |
| 799208 | 2868 | 2883 | TGATGCTTATAAAACG | 15 | 32135 | 32150 | 2122 |
| 799209 | 2871 | 2886 | TAATGATGCTTATAAA | 14 | 32138 | 32153 | 2123 |
| 799210 | 2875 | 2890 | TAAATAATGATGCTTA | 10 | 32142 | 32157 | 2124 |
| 799211 | 2878 | 2893 | ACATAAATAATGATGC | 0 | 32145 | 32160 | 2125 |
| 799212 | 2896 | 2911 | TTATACACATTGCACA | 35 | 32163 | 32178 | 2126 |
| 799219 | 2956 | 2971 | TGGCATTTGTTATTTG | 0 | 32223 | 32238 | 2127 |
| 799220 | 2960 | 2975 | AATTTGGCATTTGTTA | 0 | 32227 | 32242 | 2128 |
| 799221 | 2963 | 2978 | TTTAATTTGGCATTTG | 0 | 32230 | 32245 | 2129 |
| 799222 | 2967 | 2982 | CTTTTTTAATTTGGCA | 0 | 32234 | 32249 | 2130 |
| 799223 | 2980 | 2995 | ATCTTGTGTTTATCTT | 0 | 32247 | 32262 | 2131 |
| 799224 | 2983 | 2998 | CCAATCTTGTGTTTAT | 3 | 32250 | 32265 | 2132 |
| 799225 | 2986 | 3001 | ACACCAATCTTGTGTT | 4 | 32253 | 32268 | 2133 |
| 799226 | 2989 | 3004 | AAAACACCAATCTTGT | 15 | 32256 | 32271 | 2134 |
| 799227 | 2993 | 3008 | GAAAAAAACACCAATC | 2 | 32260 | 32275 | 2135 |
| 799228 | 2997 | 3012 | CATAGAAAAAAACACC | 4 | 32264 | 32279 | 2136 |
| 799236 | 3037 | 3052 | TAAACTCCTTTAGAAA | 45 | 32304 | 32319 | 2137 |
| 799237 | 3040 | 3055 | ACATAAACTCCTTTAG | 9 | 32307 | 32322 | 2138 |
| 790630 | 3043 | 3058 | GGAACATAAACTCCTT | 0 | 32310 | 32325 | 2139 |
| 799238 | 3046 | 3061 | AATGGAACATAAACTC | 17 | 32313 | 32328 | 2140 |
| 790631 | 3050 | 3065 | GTTTAATGGAACATAA | 0 | 32317 | 32332 | 2141 |

TABLE 9

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 772535 | 215 | 230 | CCGCACACCATGAAGA | 29 | 1710 | 1725 | 2142 |
| 772540 | 261 | 276 | AGGCGAGGAGAAAAGT | 10 | 1756 | 1771 | 2143 |
| 772551 | 550 | 565 | TTCAGATCCGCCTCGG | 39 | 2045 | 2060 | 2144 |
| 772552 | 555 | 570 | GCGCCTTCAGATCCGC | 34 | 2050 | 2065 | 2145 |
| 772553 | 576 | 591 | TCTTGAGCACCGAGTG | 59 | 2071 | 2086 | 2146 |
| 772567 | 794 | 809 | GACTTCCGAGGAATGC | 58 | 2289 | 2304 | 2147 |
| 772568 | 802 | 817 | AGCCTCTTGACTTCCG | 45 | 2297 | 2312 | 700 |
| 772571 | 823 | 838 | CCGTAAGATTCACAGC | 50 | 2318 | 2333 | 2148 |
| 772578 | 915 | 930 | GGTATCTGGAGTAAGG | 63 | 3784 | 3799 | 2149 |
| 772582 | 1014 | 1029 | CTGAAAGCCCCCCAGG | 34 | 9711 | 9726 | 2150 |
| 772584 | 1026 | 1041 | GAAGTTGGGAATCTGA | 4 | N/A | N/A | 2151 |
| 772589 | 1047 | 1062 | ACCGATCCCCAGGCTC | 9 | 30314 | 30329 | 2152 |
| 772591 | 1053 | 1068 | AGTGTGACCGATCCCC | 60 | 30320 | 30335 | 2153 |
| 772592 | 1057 | 1072 | CACCAGTGTGACCGAT | 24 | 30324 | 30339 | 2154 |
| 772593 | 1060 | 1075 | ACGCACCAGTGTGACC | 42 | 30327 | 30342 | 2155 |
| 772595 | 1063 | 1078 | ACCACGCACCAGTGTG | 2 | 30330 | 30345 | 2156 |
| 772604 | 1154 | 1169 | ATTCCCCTGAGGTAGA | 48 | 30421 | 30436 | 2157 |
| 772611 | 1169 | 1184 | TCCGAGGCAAAAGCCA | 14 | 30436 | 30451 | 2158 |
| 772614 | 1194 | 1209 | GACTCTTGTTGTCCGA | 43 | 30461 | 30476 | 2159 |
| 772623 | 1326 | 1341 | AGTCCGGGTTGTCCAG | 42 | 30593 | 30608 | 2160 |
| 772635 | 1468 | 1483 | AAGCTGATCTGCACGG | 43 | 30735 | 30750 | 2161 |
| 772687 | 2701 | 2716 | ACCTTTGTAGTTAGAA | 46 | 31968 | 31983 | 2162 |
| 772711 | 2988 | 3003 | AAACACCAATCTTGTG | 0 | 32255 | 32270 | 2163 |
| 772713 | 3005 | 3020 | ATAACACCCATAGAAA | 24 | 32272 | 32287 | 2164 |
| 772714 | 3010 | 3025 | AGGTGATAACACCCAT | 0 | 32277 | 32292 | 2165 |
| 772715 | 3014 | 3029 | AGCTAGGTGATAACAC | 0 | 32281 | 32296 | 2166 |
| 772732 | N/A | N/A | GATATTAGCTGTCAG | 58 | 3610 | 3625 | 2167 |
| 772733 | N/A | N/A | GGTGATTGCCTTGATA | 39 | 3622 | 3637 | 2168 |
| 772734 | N/A | N/A | AGGCAGGGCCGCGAGG | 16 | 3639 | 3654 | 2169 |
| 772735 | N/A | N/A | AACTGTTTGTCTTAGC | 52 | 3667 | 3682 | 2170 |
| 772738 | N/A | N/A | ACCAGTTGGTTTGAGA | 16 | 3810 | 3825 | 2171 |
| 772739 | N/A | N/A | TACTCACCAGTTGGTT | 0 | 3815 | 3830 | 2172 |
| 772762 | N/A | N/A | ATTTTGCTACCTAATG | 11 | 5481 | 5496 | 2173 |
| 772765 | N/A | N/A | GATTGGCAGGTTAATC | 35 | 5580 | 5595 | 2174 |
| 772808 | N/A | N/A | CCCCATTCATTAAGCC | 34 | 12507 | 12522 | 2175 |
| 772809 | N/A | N/A | CCTAAACTGAGCCCCA | 48 | 12518 | 12533 | 2176 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 772858 | N/A | N/A | AGTGTTCAACAATGCT | 62 | 18353 | 18368 | 2177 |
| 772929 | N/A | N/A | CGGAAGTCTTGTATTT | 37 | 29086 | 29101 | 2178 |
| 790463 | 206 | 221 | ATGAAGAAGTCGGGCG | 53 | 1701 | 1716 | 2179 |
| 790469 | 304 | 319 | CGGACGAGCGCAGATC | 41 | 1799 | 1814 | 2180 |
| 790471 | 333 | 348 | CGCCGGGCGCACGGCT | 4 | 1828 | 1843 | 2181 |
| 790484 | 761 | 776 | GAACACTTTGCACAGC | 62 | 2256 | 2271 | 2182 |
| 790486 | 781 | 796 | TGCCTGAGATCCGGCC | 23 | 2276 | 2291 | 2183 |
| 790488 | 791 | 806 | TTCCGAGGAATGCCTG | 81 | 2286 | 2301 | 2184 |
| 790491 | 821 | 836 | GTAAGATTCACAGCAA | 56 | 2316 | 2331 | 2185 |
| 790498 | 887 | 902 | CTCTAGTTCGCAGAGT | 11 | N/A | N/A | 2186 |
| 790508 | 1064 | 1079 | CACCACGCACCAGTGT | 0 | 30331 | 30346 | 2187 |
| 790516 | 1286 | 1301 | GTAACTGCTGCGGTTG | 45 | 30553 | 30568 | 2188 |
| 790519 | 1330 | 1345 | CTGGAGTCCGGGTTGT | 8 | 30597 | 30612 | 2189 |
| 790521 | 1401 | 1416 | GGCTGTACGCCTTCTC | 19 | 30668 | 30683 | 2190 |
| 790529 | 1467 | 1482 | AGCTGATCTGCACGGT | 65 | 30734 | 30749 | 2191 |
| 790537 | 1614 | 1629 | AGCAGCAAAGTAGTTT | 27 | 30881 | 30896 | 2192 |
| 790604 | 2625 | 2640 | TACGAGTGTATGAGTT | 30 | 31892 | 31907 | 2193 |
| 790605 | 2629 | 2644 | ATCATACGAGTGTATG | 32 | 31896 | 31911 | 2194 |
| 790609 | 2668 | 2683 | GTCTAAACATGCTCAT | 40 | 31935 | 31950 | 2195 |
| 790611 | 2680 | 2695 | GCTTATGTTAAAGTCT | 59 | 31947 | 31962 | 2196 |
| 790612 | 2704 | 2719 | TAAACCTTTGTAGTTA | 64 | 31971 | 31986 | 2197 |
| 790615 | 2731 | 2746 | CCAATGAGAATGCTTC | 40 | 31998 | 32013 | 2109 |
| 790616 | 2739 | 2754 | CTAAATTTCCAATGAG | 66 | 32006 | 32021 | 2198 |
| 790618 | 2751 | 2766 | AGCACTACAATGCTAA | 24 | 32018 | 32033 | 2199 |
| 790637 | N/A | N/A | ACCTAGTTCGCAGAGT | 0 | 2382 | 2397 | 2200 |
| 790647 | N/A | N/A | CGCGAGGCGGTGATTG | 24 | 3630 | 3645 | 2201 |
| 790652 | N/A | N/A | CACCAGTTGGTTTGAG | 25 | 3811 | 3826 | 2202 |
| 790659 | N/A | N/A | TGCCAGTCTCAAATGG | 27 | 4459 | 4474 | 2203 |
| 790666 | N/A | N/A | TAATTTATGACAACGC | 72 | 4866 | 4881 | 2204 |
| 790674 | N/A | N/A | TGCTACCTAATGTCAA | 40 | 5477 | 5492 | 2205 |
| 790678 | N/A | N/A | TCCTATTGGCTGATCT | 46 | 5561 | 5576 | 2206 |
| 790679 | N/A | N/A | AGGTTAATCACTTCCT | 13 | 5573 | 5588 | 2207 |
| 790693 | N/A | N/A | CAAAGTATACCTGTTC | 45 | 7676 | 7691 | 2208 |
| 790696 | N/A | N/A | CAAAGGTAAGCCAGCT | 41 | 7810 | 7825 | 2209 |
| 790697 | N/A | N/A | ATTCAGGGTGTCAGCC | 59 | 7836 | 7851 | 2210 |
| 790701 | N/A | N/A | GGATACACTTAATCAA | 57 | 8125 | 8140 | 2211 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 790732 | N/A | N/A | GCTTATTTCATGTGGT | 69 | 11190 | 11205 | 2212 |
| 790736 | N/A | N/A | TCAAACTTTGAAGCCT | 60 | 11988 | 12003 | 2213 |
| 790741 | N/A | N/A | ATTAAGCCCGCTCTCA | 30 | 12499 | 12514 | 2214 |
| 790747 | N/A | N/A | GTACAATCTCCTGGAA | 8 | 12941 | 12956 | 2215 |
| 790754 | N/A | N/A | CTAAGCTACTTGGTTT | 38 | 14094 | 14109 | 2216 |
| 790775 | N/A | N/A | TACAAGGTGAAAGTTA | 7 | 17280 | 17295 | 2217 |
| 790791 | N/A | N/A | GGGCACACCACCTGCC | 7 | 18421 | 18436 | 2218 |
| 790855 | N/A | N/A | ACCTTTTCCGGTATTT | 40 | 26989 | 27004 | 2219 |
| 790871 | N/A | N/A | TGTTAGGACCTGGGAA | 39 | 28757 | 28772 | 2220 |
| 790874 | N/A | N/A | CCGGAAGTCTTGTATT | 0 | 29087 | 29102 | 2221 |
| 798764 | 757 | 772 | ACTTTGCACAGCAGGA | 75 | 2252 | 2267 | 694 |
| 798781 | 822 | 837 | CGTAAGATTCACAGCA | 69 | 2317 | 2332 | 1456 |
| 799143 | 2562 | 2577 | TGGGTTATGACGGACC | 61 | 31829 | 31844 | 1320 |
| 799144 | 2563 | 2578 | TTGGGTTATGACGGAC | 72 | 31830 | 31845 | 1321 |
| 799184 | 2702 | 2717 | AACCTTTGTAGTTAGA | 48 | 31969 | 31984 | 1341 |
| 799396 | N/A | N/A | TGTTACAAATACAGAG | 66 | 5078 | 5093 | 1516 |
| 799566 | N/A | N/A | GAGTAAACAATACCCT | 89 | 10898 | 10913 | 1629 |
| 799572 | N/A | N/A | ACCATCTAACAACATC | 55 | 11125 | 11140 | 1635 |
| 799583 | N/A | N/A | AAGACAAACCTTCCGA | 74 | 11237 | 11252 | 1637 |
| 800109 | N/A | N/A | ACAGCCACAAGTCACA | 88 | 6284 | 6299 | 783 |
| 800768 | 116 | 131 | GCGCTCCGTGGCATGC | 18 | 1611 | 1626 | 2222 |
| 800769 | 171 | 186 | GCAGGCGACAGCAGCA | 49 | 1666 | 1681 | 2223 |
| 800771 | 387 | 402 | CCCGCAGCTCGCCTCC | 46 | 1882 | 1897 | 2224 |
| 800776 | 650 | 665 | GAGGCACGCGGTGCGC | 36 | 2145 | 2160 | 2225 |
| 800786 | 1058 | 1073 | GCACCAGTGTGACCGA | 0 | 30325 | 30340 | 2226 |
| 800787 | 1105 | 1120 | CAGTAGAGCCTCCCCA | 38 | 30372 | 30387 | 2227 |
| 800793 | 1195 | 1210 | TGACTCTTGTTGTCCG | 53 | 30462 | 30477 | 2228 |
| 800795 | 1285 | 1300 | TAACTGCTGCGGTTGT | 12 | 30552 | 30567 | 2229 |
| 800798 | 1331 | 1346 | CCTGGAGTCCGGGTTG | 36 | 30598 | 30613 | 2230 |
| 800821 | 2740 | 2755 | GCTAAATTTCCAATGA | 56 | 32007 | 32022 | 2231 |
| 800837 | 2703 | 2718 | AAACCTTTGTAGTTAG | 41 | 31970 | 31985 | 2232 |
| 800843 | N/A | N/A | TCGGCCACACACCTCA | 32 | 2777 | 2792 | 2233 |
| 800858 | N/A | N/A | AGCCCAACTGTTTGTC | 40 | 3672 | 3687 | 2234 |
| 800861 | N/A | N/A | CCAGTTGGTTTGAGAA | 32 | 3809 | 3824 | 2235 |
| 800883 | N/A | N/A | ACCATTTATCTGGTGT | 50 | 5039 | 5054 | 2236 |
| 800998 | N/A | N/A | CCCGCTCTCAGCCAGG | 39 | 12493 | 12508 | 2237 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 800999 | N/A | N/A | CATTCATTAAGCCCGC | 54 | 12504 | 12519 | 2238 |
| 801003 | N/A | N/A | GAATCAAGCCCTGGCT | 38 | 12557 | 12572 | 2239 |
| 801040 | N/A | N/A | GTCATGAAAGATTCTT | 72 | 17588 | 17603 | 2240 |
| 801051 | N/A | N/A | GTGTTCAACAATGCTT | 68 | 18352 | 18367 | 2241 |
| 801128 | N/A | N/A | AGTATCCATCAACTGC | 48 | 28270 | 28285 | 2242 |
| 801132 | N/A | N/A | GGTGACTCATCAGGCA | 55 | 28303 | 28318 | 2243 |
| 801138 | N/A | N/A | GTTAGGACCTGGGAAC | 6 | 28756 | 28771 | 2244 |
| 801145 | N/A | N/A | ACGCTGTGGTTTGTGG | 0 | 29117 | 29132 | 2245 |
| 829715 | 95 | 110 | TCTCCCGGAGGCCGGG | 40 | 1590 | 1605 | 2246 |
| 829716 | 96 | 111 | GTCTCCCGGAGGCCGG | 10 | 1591 | 1606 | 2247 |
| 829717 | 97 | 112 | AGTCTCCCGGAGGCCG | 28 | 1592 | 1607 | 2248 |
| 829718 | 99 | 114 | CCAGTCTCCCGGAGGC | 15 | 1594 | 1609 | 2249 |
| 829719 | 100 | 115 | GCCAGTCTCCCGGAGG | 15 | 1595 | 1610 | 2250 |
| 829720 | 102 | 117 | GCGCCAGTCTCCCGGA | 14 | 1597 | 1612 | 2251 |
| 829721 | 103 | 118 | TGCGCCAGTCTCCCGG | 33 | 1598 | 1613 | 2252 |
| 829722 | 104 | 119 | ATGCGCCAGTCTCCCG | 38 | 1599 | 1614 | 2253 |
| 829723 | 106 | 121 | GCATGCGCCAGTCTCC | 54 | 1601 | 1616 | 2254 |
| 829724 | 107 | 122 | GGCATGCGCCAGTCTC | 54 | 1602 | 1617 | 2255 |
| 829725 | 111 | 126 | CCGTGGCATGCGCCAG | 41 | 1606 | 1621 | 2256 |
| 829726 | 113 | 128 | CTCCGTGGCATGCGCC | 41 | 1608 | 1623 | 2257 |
| 829727 | 114 | 129 | GCTCCGTGGCATGCGC | 35 | 1609 | 1624 | 2258 |
| 829728 | 174 | 189 | GGCGCAGGCGACAGCA | 44 | 1669 | 1684 | 2259 |
| 829729 | 175 | 190 | AGGCGCAGGCGACAGC | 66 | 1670 | 1685 | 2260 |
| 829730 | 177 | 192 | GCAGGCGCAGGCGACA | 23 | 1672 | 1687 | 2261 |
| 829731 | 178 | 193 | AGCAGGCGCAGGCGAC | 50 | 1673 | 1688 | 2262 |
| 829732 | 207 | 222 | CATGAAGAAGTCGGGC | 40 | 1702 | 1717 | 2263 |
| 829733 | 209 | 224 | ACCATGAAGAAGTCGG | 54 | 1704 | 1719 | 2264 |
| 829734 | 216 | 231 | TCCGCACACCATGAAG | 71 | 1711 | 1726 | 2265 |
| 829735 | 218 | 233 | CCTCCGCACACCATGA | 61 | 1713 | 1728 | 2266 |
| 829736 | 231 | 246 | GGAGCGAACATGACCT | 41 | 1726 | 1741 | 2267 |
| 829737 | 232 | 247 | AGGAGCGAACATGACC | 52 | 1727 | 1742 | 2268 |
| 829738 | 234 | 249 | TAAGGAGCGAACATGA | 49 | 1729 | 1744 | 2269 |
| 829739 | 237 | 252 | TGCTAAGGAGCGAACA | 44 | 1732 | 1747 | 2270 |
| 829740 | 238 | 253 | CTGCTAAGGAGCGAAC | 52 | 1733 | 1748 | 2271 |
| 829741 | 305 | 320 | CCGGACGAGCGCAGAT | 32 | 1800 | 1815 | 2272 |
| 829742 | 307 | 322 | CGCCGGACGAGCGCAG | 43 | 1802 | 1817 | 2273 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829743 | 308 | 323 | ACGCCGGACGAGCGCA | 25 | 1803 | 1818 | 2274 |
| 829744 | 323 | 338 | ACGGCTCCTCCAGAGA | 39 | 1818 | 1833 | 2275 |
| 829745 | 330 | 345 | CGGGCGCACGGCTCCT | 19 | 1825 | 1840 | 2276 |
| 829746 | 331 | 346 | CCGGGCGCACGGCTCC | 46 | 1826 | 1841 | 2277 |
| 829747 | 337 | 352 | TCGCCGCCGGGCGCAC | 16 | 1832 | 1847 | 2278 |
| 829748 | 338 | 353 | CTCGCCGCCGGGCGCA | 43 | 1833 | 1848 | 2279 |
| 829749 | 340 | 355 | TCCTCGCCGCCGGGCG | 26 | 1835 | 1850 | 2280 |
| 829750 | 342 | 357 | CGTCCTCGCCGCCGGG | 33 | 1837 | 1852 | 2281 |
| 829751 | 384 | 399 | GCAGCTCGCCTCCTCC | 40 | 1879 | 1894 | 2282 |
| 829752 | 386 | 401 | CCGCAGCTCGCCTCCT | 27 | 1881 | 1896 | 2283 |
| 829753 | 389 | 404 | TCCCCGCAGCTCGCCT | 29 | 1884 | 1899 | 2284 |
| 829754 | 391 | 406 | TCTCCCCGCAGCTCGC | 49 | 1886 | 1901 | 2285 |
| 829755 | 392 | 407 | TTCTCCCCGCAGCTCG | 52 | 1887 | 1902 | 2286 |
| 829756 | 402 | 417 | CCGTCGCCCCTTCTCC | 42 | 1897 | 1912 | 2287 |
| 829757 | 424 | 439 | CCGGCCCCATGCGCTC | 15 | 1919 | 1934 | 2288 |
| 829758 | 426 | 441 | CACCGGCCCCATGCGC | 24 | 1921 | 1936 | 2289 |
| 829759 | 430 | 445 | CCGCCACCGGCCCCAT | 51 | 1925 | 1940 | 2290 |
| 829760 | 468 | 483 | CCGCCTTGCCCAGGCA | 3 | 1963 | 1978 | 2291 |
| 829761 | 549 | 564 | TCAGATCCGCCTCGGC | 21 | 2044 | 2059 | 2292 |
| 829762 | 552 | 567 | CCTTCAGATCCGCCTC | 67 | 2047 | 2062 | 2293 |
| 829763 | 579 | 594 | GTTTCTTGAGCACCGA | 65 | 2074 | 2089 | 2294 |
| 829764 | 590 | 605 | CCGCTCCTTCAGTTTC | 44 | 2085 | 2100 | 2295 |
| 829765 | 591 | 606 | GCCGCTCCTTCAGTTT | 28 | 2086 | 2101 | 2296 |
| 829766 | 593 | 608 | CTGCCGCTCCTTCAGT | 32 | 2088 | 2103 | 2297 |
| 829767 | 651 | 666 | GGAGGCACGCGGTGCG | 66 | 2146 | 2161 | 2298 |
| 829768 | 654 | 669 | GCAGGAGGCACGCGGT | 41 | 2149 | 2164 | 2299 |
| 829769 | 656 | 671 | CAGCAGGAGGCACGCG | 46 | 2151 | 2166 | 2300 |
| 829770 | 673 | 688 | CAGTCCAGGCGGCCGG | 42 | 2168 | 2183 | 2301 |
| 829771 | 674 | 689 | GCAGTCCAGGCGGCCG | 22 | 2169 | 2184 | 2302 |
| 829772 | 729 | 744 | AGGACGAGGGCGGCTG | 52 | 2224 | 2239 | 2303 |
| 829773 | 731 | 746 | GTAGGACGAGGGCGGC | 50 | 2226 | 2241 | 2304 |
| 829774 | 732 | 747 | AGTAGGACGAGGGCGG | 22 | 2227 | 2242 | 2305 |
| 829775 | 734 | 749 | CGAGTAGGACGAGGGC | 59 | 2229 | 2244 | 2306 |
| 829776 | 735 | 750 | GCGAGTAGGACGAGGG | 64 | 2230 | 2245 | 2307 |
| 829777 | 737 | 752 | GAGCGAGTAGGACGAG | 37 | 2232 | 2247 | 2308 |
| 829778 | 738 | 753 | GGAGCGAGTAGGACGA | 46 | 2233 | 2248 | 2309 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829779 | 739 | 754 | GGGAGCGAGTAGGACG | 58 | 2234 | 2249 | 2310 |
| 829780 | 770 | 785 | CGGCCACCTGAACACT | 37 | 2265 | 2280 | 2311 |
| 829781 | 771 | 786 | CCGGCCACCTGAACAC | 31 | 2266 | 2281 | 2312 |
| 829782 | 773 | 788 | ATCCGGCCACCTGAAC | 36 | 2268 | 2283 | 2313 |
| 829783 | 774 | 789 | GATCCGGCCACCTGAA | 52 | 2269 | 2284 | 2314 |
| 829784 | 775 | 790 | AGATCCGGCCACCTGA | 32 | 2270 | 2285 | 2315 |
| 829785 | 782 | 797 | ATGCCTGAGATCCGGC | 27 | 2277 | 2292 | 2316 |
| 829786 | 784 | 799 | GAATGCCTGAGATCCG | 56 | 2279 | 2294 | 2317 |
| 829787 | 785 | 800 | GGAATGCCTGAGATCC | 30 | 2280 | 2295 | 2318 |
| 829788 | 790 | 805 | TCCGAGGAATGCCTGA | 41 | 2285 | 2300 | 2319 |
| 829789 | 793 | 808 | ACTTCCGAGGAATGCC | 42 | 2288 | 2303 | 2320 |
| 829790 | 824 | 839 | CCCGTAAGATTCACAG | 51 | 2319 | 2334 | 2321 |
| 829791 | 826 | 841 | TTCCCGTAAGATTCAC | 38 | 2321 | 2336 | 2322 |
| 829792 | 827 | 842 | CTTCCCGTAAGATTCA | 39 | 2322 | 2337 | 2323 |
| 829793 | 828 | 843 | TCTTCCCGTAAGATTC | 41 | 2323 | 2338 | 2324 |
| 829794 | 830 | 845 | GATCTTCCCGTAAGAT | 24 | 2325 | 2340 | 2325 |
| 829795 | 831 | 846 | TGATCTTCCCGTAAGA | 34 | 2326 | 2341 | 2326 |
| 829796 | 832 | 847 | TTGATCTTCCCGTAAG | 27 | 2327 | 2342 | 2327 |
| 829797 | 834 | 849 | GGTTGATCTTCCCGTA | 54 | 2329 | 2344 | 2328 |
| 829798 | 835 | 850 | GGGTTGATCTTCCCGT | 26 | 2330 | 2345 | 2329 |
| 829799 | 872 | 887 | TCGGCTAAGGTGATGG | 51 | 2367 | 2382 | 2330 |
| 829800 | 873 | 888 | GTCGGCTAAGGTGATG | 30 | 2368 | 2383 | 2331 |
| 829801 | 874 | 889 | AGTCGGCTAAGGTGAT | 8 | 2369 | 2384 | 2332 |
| 829802 | 881 | 896 | TTCGCAGAGTCGGCTA | 28 | 2376 | 2391 | 2333 |
| 829803 | 883 | 898 | AGTTCGCAGAGTCGGC | 35 | 2378 | 2393 | 2334 |
| 829804 | 884 | 899 | TAGTTCGCAGAGTCGG | 39 | 2379 | 2394 | 2335 |
| 829805 | 886 | 901 | TCTAGTTCGCAGAGTC | 37 | N/A | N/A | 2336 |
| 829806 | 889 | 904 | GACTCTAGTTCGCAGA | 41 | N/A | N/A | 2337 |
| 829807 | 890 | 905 | AGACTCTAGTTCGCAG | 41 | N/A | N/A | 2338 |
| 829808 | 892 | 907 | GGAGACTCTAGTTCGC | 53 | N/A | N/A | 2339 |
| 829809 | 893 | 908 | GGGAGACTCTAGTTCG | 51 | N/A | N/A | 2340 |
| 829810 | 919 | 934 | ATCGGGTATCTGGAGT | 29 | 3788 | 3803 | 2341 |
| 829811 | 922 | 937 | TCCATCGGGTATCTGG | 0 | 3791 | 3806 | 2342 |
| 829814 | 944 | 959 | GTCTGCAGTTGGTTTG | 94 | N/A | N/A | 2343 |
| 829822 | 977 | 992 | TGTTTCAGCGGAGGAA | 43 | 9674 | 9689 | 2344 |
| 829829 | 1015 | 1030 | TCTGAAAGCCCCCCAG | 11 | N/A | N/A | 2345 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829830 | 1017 | 1032 | AATCTGAAAGCCCCCC | 36 | N/A | N/A | 2346 |
| 829831 | 1048 | 1063 | GACCGATCCCCAGGCT | 9 | 30315 | 30330 | 2347 |
| 829832 | 1049 | 1064 | TGACCGATCCCCAGGC | 51 | 30316 | 30331 | 2348 |
| 829833 | 1050 | 1065 | GTGACCGATCCCCAGG | 0 | 30317 | 30332 | 2349 |
| 829834 | 1052 | 1067 | GTGTGACCGATCCCCA | 29 | 30319 | 30334 | 2350 |
| 829835 | 1054 | 1069 | CAGTGTGACCGATCCC | 52 | 30321 | 30336 | 2351 |
| 829836 | 1055 | 1070 | CCAGTGTGACCGATCC | 48 | 30322 | 30337 | 2352 |
| 829837 | 1073 | 1088 | CCAGTATGCCACCACG | 16 | 30340 | 30355 | 2353 |
| 829838 | 1074 | 1089 | CCCAGTATGCCACCAC | 28 | 30341 | 30356 | 2354 |
| 829839 | 1108 | 1123 | ACACAGTAGAGCCTCC | 8 | 30375 | 30390 | 2355 |
| 829840 | 1110 | 1125 | GGACACAGTAGAGCCT | 0 | 30377 | 30392 | 2356 |
| 829841 | 1111 | 1126 | TGGACACAGTAGAGCC | 50 | 30378 | 30393 | 2357 |
| 829842 | 1168 | 1183 | CCGAGGCAAAAGCCAT | 26 | 30435 | 30450 | 2358 |
| 829843 | 1180 | 1195 | GAATTGAGCTGTCCGA | 49 | 30447 | 30462 | 2359 |
| 829844 | 1181 | 1196 | CGAATTGAGCTGTCCG | 49 | 30448 | 30463 | 2360 |
| 829845 | 1183 | 1198 | TCCGAATTGAGCTGTC | 40 | 30450 | 30465 | 2361 |
| 829846 | 1184 | 1199 | GTCCGAATTGAGCTGT | 29 | 30451 | 30466 | 2362 |
| 829847 | 1185 | 1200 | TGTCCGAATTGAGCTG | 64 | 30452 | 30467 | 2363 |
| 829848 | 1186 | 1201 | TTGTCCGAATTGAGCT | 47 | 30453 | 30468 | 2364 |
| 829849 | 1188 | 1203 | TGTTGTCCGAATTGAG | 49 | 30455 | 30470 | 2365 |
| 829850 | 1189 | 1204 | TTGTTGTCCGAATTGA | 36 | 30456 | 30471 | 2366 |
| 829851 | 1190 | 1205 | CTTGTTGTCCGAATTG | 31 | 30457 | 30472 | 2367 |
| 829852 | 1191 | 1206 | TCTTGTTGTCCGAATT | 33 | 30458 | 30473 | 2368 |
| 829853 | 1193 | 1208 | ACTCTTGTTGTCCGAA | 42 | 30460 | 30475 | 2369 |
| 829854 | 1197 | 1212 | GCTGACTCTTGTTGTC | 25 | 30464 | 30479 | 2370 |
| 829855 | 1198 | 1213 | AGCTGACTCTTGTTGT | 0 | 30465 | 30480 | 2371 |
| 829856 | 1201 | 1216 | ACCAGCTGACTCTTGT | 41 | 30468 | 30483 | 2372 |
| 829857 | 1204 | 1219 | TGCACCAGCTGACTCT | 31 | 30471 | 30486 | 2373 |
| 829858 | 1218 | 1233 | TGCTCCGCACCTTCTG | 59 | 30485 | 30500 | 2374 |
| 829859 | 1221 | 1236 | TTTTGCTCCGCACCTT | 39 | 30488 | 30503 | 2375 |
| 829860 | 1243 | 1258 | GTCAGCTGGATGCCGC | 31 | 30510 | 30525 | 2376 |
| 829861 | 1258 | 1273 | CCATCCACCTCCCGCG | 35 | 30525 | 30540 | 2377 |
| 829862 | 1282 | 1297 | CTGCTGCGGTTGTACA | 22 | 30549 | 30564 | 2378 |
| 829863 | 1283 | 1298 | ACTGCTGCGGTTGTAC | 31 | 30550 | 30565 | 2379 |
| 829864 | 1288 | 1303 | GGGTAACTGCTGCGGT | 68 | 30555 | 30570 | 2380 |
| 829865 | 1307 | 1322 | GGCGGACTTGATGAAG | 30 | 30574 | 30589 | 2381 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829866 | 1309 | 1324 | GTGGCGGACTTGATGA | 10 | 30576 | 30591 | 2382 |
| 829867 | 1310 | 1325 | TGTGGCGGACTTGATG | 22 | 30577 | 30592 | 2383 |
| 829868 | 1312 | 1327 | AGTGTGGCGGACTTGA | 52 | 30579 | 30594 | 2384 |
| 829869 | 1313 | 1328 | CAGTGTGGCGGACTTG | 37 | 30580 | 30595 | 2385 |
| 829870 | 1314 | 1329 | CCAGTGTGGCGGACTT | 19 | 30581 | 30596 | 2386 |
| 829871 | 1316 | 1331 | GTCCAGTGTGGCGGAC | 1 | 30583 | 30598 | 2387 |
| 829872 | 1317 | 1332 | TGTCCAGTGTGGCGGA | 50 | 30584 | 30599 | 2388 |
| 829873 | 1318 | 1333 | TTGTCCAGTGTGGCGG | 52 | 30585 | 30600 | 2389 |
| 829874 | 1319 | 1334 | GTTGTCCAGTGTGGCG | 43 | 30586 | 30601 | 2390 |
| 829875 | 1322 | 1337 | CGGGTTGTCCAGTGTG | 52 | 30589 | 30604 | 2391 |
| 829876 | 1323 | 1338 | CCGGGTTGTCCAGTGT | 30 | 30590 | 30605 | 2392 |
| 829877 | 1324 | 1339 | TCCGGGTTGTCCAGTG | 42 | 30591 | 30606 | 2393 |
| 829878 | 1327 | 1342 | GAGTCCGGGTTGTCCA | 18 | 30594 | 30609 | 2394 |
| 829879 | 1329 | 1344 | TGGAGTCCGGGTTGTC | 29 | 30596 | 30611 | 2395 |
| 829880 | 1332 | 1347 | TCCTGGAGTCCGGGTT | 32 | 30599 | 30614 | 2396 |
| 829881 | 1334 | 1349 | CGTCCTGGAGTCCGGG | 39 | 30601 | 30616 | 2397 |
| 829882 | 1402 | 1417 | AGGCTGTACGCCTTCT | 3 | 30669 | 30684 | 2398 |
| 829883 | 1403 | 1418 | CAGGCTGTACGCCTTC | 0 | 30670 | 30685 | 2399 |
| 829884 | 1405 | 1420 | TGCAGGCTGTACGCCT | 24 | 30672 | 30687 | 2400 |
| 829885 | 1409 | 1424 | CCGCTGCAGGCTGTAC | 31 | 30676 | 30691 | 2401 |
| 829886 | 1421 | 1436 | GTGGTCATTGGGCCGC | 6 | 30688 | 30703 | 2402 |
| 829887 | 1422 | 1437 | CGTGGTCATTGGGCCG | 47 | 30689 | 30704 | 2403 |
| 829888 | 1444 | 1459 | GTCCACGGCTGCTGCA | 47 | 30711 | 30726 | 2404 |
| 829889 | 1445 | 1460 | CGTCCACGGCTGCTGC | 48 | 30712 | 30727 | 2405 |
| 829890 | 1450 | 1465 | AAGCCCGTCCACGGCT | 0 | 30717 | 30732 | 2406 |
| 829891 | 1462 | 1477 | ATCTGCACGGTAAAGC | 25 | 30729 | 30744 | 2407 |
| 829892 | 1463 | 1478 | GATCTGCACGGTAAAG | 32 | 30730 | 30745 | 2408 |
| 829893 | 1464 | 1479 | TGATCTGCACGGTAAA | 14 | 30731 | 30746 | 2409 |
| 829894 | 1466 | 1481 | GCTGATCTGCACGGTA | 41 | 30733 | 30748 | 2410 |
| 829895 | 1473 | 1488 | TCACAAAGCTGATCTG | 37 | 30740 | 30755 | 2411 |
| 829896 | 1498 | 1513 | CGGGTGTAGCACTGGC | 44 | 30765 | 30780 | 2412 |
| 829897 | 1499 | 1514 | GCGGGTGTAGCACTGG | 40 | 30766 | 30781 | 2413 |
| 829898 | 1501 | 1516 | TGGCGGGTGTAGCACT | 31 | 30768 | 30783 | 2414 |
| 829899 | 1521 | 1536 | ACGGGCAGCTGCTGAT | 20 | 30788 | 30803 | 2415 |
| 829900 | 1522 | 1537 | CACGGGCAGCTGCTGA | 0 | 30789 | 30804 | 2416 |
| 829901 | 1524 | 1539 | AGCACGGGCAGCTGCT | 10 | 30791 | 30806 | 2417 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829902 | 1525 | 1540 | CAGCACGGGCAGCTGC | 0 | 30792 | 30807 | 2418 |
| 829903 | 1546 | 1561 | CTGTTGAAGATGACCT | 25 | 30813 | 30828 | 2419 |
| 829904 | 1547 | 1562 | GCTGTTGAAGATGACC | 21 | 30814 | 30829 | 2420 |
| 829905 | 1549 | 1564 | CGGCTGTTGAAGATGA | 20 | 30816 | 30831 | 2421 |
| 829906 | 1550 | 1565 | CCGGCTGTTGAAGATG | 0 | 30817 | 30832 | 2422 |
| 829907 | 1551 | 1566 | ACCGGCTGTTGAAGAT | 23 | 30818 | 30833 | 2423 |
| 829908 | 1553 | 1568 | CTACCGGCTGTTGAAG | 1 | 30820 | 30835 | 2424 |
| 829909 | 1556 | 1571 | CGGCTACCGGCTGTTG | 34 | 30823 | 30838 | 2425 |
| 829910 | 1653 | 1668 | GAGTTTGCATGAAAAG | 49 | 30920 | 30935 | 2426 |
| 829911 | 1661 | 1676 | CGACCAAAGAGTTTGC | 52 | 30928 | 30943 | 2427 |
| 829912 | 1663 | 1678 | AACGACCAAAGAGTTT | 24 | 30930 | 30945 | 2428 |
| 829913 | 2565 | 2580 | CCTTGGGTTATGACGG | 40 | 31832 | 31847 | 2429 |
| 829914 | 2566 | 2581 | ACCTTGGGTTATGACG | 35 | 31833 | 31848 | 2430 |
| 829915 | 2569 | 2584 | GGTACCTTGGGTTATG | 22 | 31836 | 31851 | 2431 |
| 829916 | 2594 | 2609 | GAAGAGTTAGGTGTCA | 33 | 31861 | 31876 | 2432 |
| 829917 | 2621 | 2636 | AGTGTATGAGTTGTAG | 45 | 31888 | 31903 | 2433 |
| 829918 | 2622 | 2637 | GAGTGTATGAGTTGTA | 53 | 31889 | 31904 | 2434 |
| 829919 | 2623 | 2638 | CGAGTGTATGAGTTGT | 47 | 31890 | 31905 | 2435 |
| 829920 | 2626 | 2641 | ATACGAGTGTATGAGT | 30 | 31893 | 31908 | 2436 |
| 829921 | 2628 | 2643 | TCATACGAGTGTATGA | 10 | 31895 | 31910 | 2437 |
| 829922 | 2631 | 2646 | GTATCATACGAGTGTA | 56 | 31898 | 31913 | 2438 |
| 829923 | 2632 | 2647 | AGTATCATACGAGTGT | 54 | 31899 | 31914 | 2439 |
| 829924 | 2657 | 2672 | CTCATTGAGCTAAGAA | 25 | 31924 | 31939 | 2440 |
| 829925 | 2660 | 2675 | ATGCTCATTGAGCTAA | 37 | 31927 | 31942 | 2441 |
| 829926 | 2661 | 2676 | CATGCTCATTGAGCTA | 24 | 31928 | 31943 | 2442 |
| 829927 | 2670 | 2685 | AAGTCTAAACATGCTC | 64 | 31937 | 31952 | 2443 |
| 829928 | 2749 | 2764 | CACTACAATGCTAAAT | 26 | 32016 | 32031 | 2444 |
| 829929 | 2984 | 2999 | ACCAATCTTGTGTTTA | 19 | 32251 | 32266 | 2445 |
| 829930 | 2985 | 3000 | CACCAATCTTGTGTTT | 0 | 32252 | 32267 | 2446 |
| 829931 | 2987 | 3002 | AACACCAATCTTGTGT | 0 | 32254 | 32269 | 2447 |
| 829932 | 3007 | 3022 | TGATAACACCCATAGA | 41 | 32274 | 32289 | 2448 |
| 829933 | 3008 | 3023 | GTGATAACACCCATAG | 38 | 32275 | 32290 | 2449 |
| 829934 | 3011 | 3026 | TAGGTGATAACACCCA | 26 | 32278 | 32293 | 2450 |
| 829935 | 3012 | 3027 | CTAGGTGATAACACCC | 0 | 32279 | 32294 | 2451 |
| 829936 | 3015 | 3030 | CAGCTAGGTGATAACA | 14 | 32282 | 32297 | 2452 |
| 829937 | 3017 | 3032 | TTCAGCTAGGTGATAA | 0 | 32284 | 32299 | 2453 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829938 | 3018 | 3033 | ATTCAGCTAGGTGATA | 17 | 32285 | 32300 | 2454 |
| 829939 | 3020 | 3035 | ACATTCAGCTAGGTGA | 34 | 32287 | 32302 | 2455 |
| 829944 | N/A | N/A | CCAGTTAATCATTACT | 23 | 9421 | 9436 | 2456 |
| 829945 | N/A | N/A | GCCAGTTAATCATTAC | 31 | 9422 | 9437 | 2457 |
| 829946 | N/A | N/A | GCAGCCAGTTAATCAT | 44 | 9425 | 9440 | 2458 |
| 829947 | N/A | N/A | GGGCAGCCAGTTAATC | 31 | 9427 | 9442 | 2459 |
| 829948 | N/A | N/A | CGGGCAGCCAGTTAAT | 43 | 9428 | 9443 | 2460 |
| 829949 | N/A | N/A | CCGGGCAGCCAGTTAA | 19 | 9429 | 9444 | 2461 |
| 829950 | N/A | N/A | TCCGGGCAGCCAGTTA | 43 | 9430 | 9445 | 2462 |
| 829951 | N/A | N/A | GCTCCGGGCAGCCAGT | 10 | 9432 | 9447 | 2463 |
| 829952 | N/A | N/A | ACCCGTCTGGGCTCCG | 2 | 9442 | 9457 | 2464 |
| 829953 | N/A | N/A | GTCACCCGTCTGGGCT | 34 | 9445 | 9460 | 2465 |
| 829954 | N/A | N/A | TTGTCACCCGTCTGGG | 53 | 9447 | 9462 | 2466 |
| 829955 | N A | N/A | CTTGTCACCCGTCTGG | 52 | 9448 | 9463 | 2467 |
| 829956 | N/A | N/A | CCTTGTCACCCGTCTG | 66 | 9449 | 9464 | 2468 |
| 829957 | N/A | N/A | CACCTTGTCACCCGTC | 41 | 9451 | 9466 | 2469 |
| 829958 | N/A | N/A | GCACCTTGTCACCCGT | 51 | 9452 | 9467 | 2470 |
| 829959 | N/A | N/A | TTATTAATGGTCTGCT | 12 | 9501 | 9516 | 2471 |
| 829960 | N/A | N/A | ATTATTAATGGTCTGC | 17 | 9502 | 9517 | 2472 |
| 829961 | N/A | N/A | TGATTATTAATGGTCT | 14 | 9504 | 9519 | 2473 |
| 829962 | N/A | N/A | CTGATTATTAATGGTC | 19 | 9505 | 9520 | 2474 |
| 829963 | N/A | N/A | CCTAGTTCGCAGAGTC | 46 | 2381 | 2396 | 2475 |
| 829964 | N/A | N/A | CACCTAGTTCGCAGAG | 3 | 2383 | 2398 | 2476 |
| 829965 | N/A | N/A | CTCACCTAGTTCGCAG | 0 | 2385 | 2400 | 2477 |
| 829966 | N/A | N/A | TTCCCAGGAGGGTATG | 0 | 2545 | 2560 | 2478 |
| 829967 | N/A | N/A | CCCCCAGGGAATGCCC | 0 | 2606 | 2621 | 2479 |
| 829968 | N/A | N/A | AACCCCCAGGGAATGC | 30 | 2608 | 2623 | 2480 |
| 829969 | N/A | N/A | GAACCCCCAGGGAATG | 17 | 2609 | 2624 | 2481 |
| 829970 | N/A | N/A | TGGAAGGGAACCCCCA | 0 | 2616 | 2631 | 2482 |
| 829971 | N/A | N/A | GCCACACACCTCAACG | 20 | 2774 | 2789 | 2483 |
| 829972 | N/A | N/A | CTCGGCCACACACCTC | 22 | 2778 | 2793 | 2484 |
| 829973 | N/A | N/A | AAGAGGCCGCCTGGCG | 17 | 3586 | 3601 | 2485 |
| 829974 | N/A | N/A | AAAAGAGGCCGCCTGG | 27 | 3588 | 3603 | 2486 |
| 829975 | N/A | N/A | CAAAAGAGGCCGCCTG | 32 | 3589 | 3604 | 2487 |
| 829976 | N/A | N/A | ACAAAAGAGGCCGCCT | 10 | 3590 | 3605 | 2488 |
| 829977 | N/A | N/A | TAGCTGTCAGATAAAC | 35 | 3604 | 3619 | 2489 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 829978 | N/A | N/A | ATATTTAGCTGTCAGA | 50 | 3609 | 3624 | 2490 |
| 829979 | N/A | N/A | TGATATTTAGCTGTCA | 49 | 3611 | 3626 | 2491 |
| 829980 | N/A | N/A | TTGATATTTAGCTGTC | 56 | 3612 | 3627 | 2492 |
| 829981 | N/A | N/A | GTGATTGCCTTGATAT | 14 | 3621 | 3636 | 2493 |
| 829982 | N/A | N/A | CGGTGATTGCCTTGAT | 44 | 3623 | 3638 | 2494 |
| 829983 | N/A | N/A | GGCGGTGATTGCCTTG | 43 | 3625 | 3640 | 2495 |
| 829984 | N/A | N/A | AGGCGGTGATTGCCTT | 0 | 3626 | 3641 | 2496 |
| 829985 | N/A | N/A | GAGGCGGTGATTGCCT | 16 | 3627 | 3642 | 2497 |
| 829986 | N/A | N/A | CGAGGCGGTGATTGCC | 28 | 3628 | 3643 | 2498 |
| 829987 | N/A | N/A | CCGCGAGGCGGTGATT | 6 | 3631 | 3646 | 2499 |
| 829988 | N/A | N/A | GCCGCGAGGCGGTGAT | 27 | 3632 | 3647 | 2500 |
| 829989 | N/A | N/A | GGCCGCGAGGCGGTGA | 2 | 3633 | 3648 | 2501 |
| 829990 | N/A | N/A | GGGCCGCGAGGCGGTG | 35 | 3634 | 3649 | 2502 |
| 829991 | N/A | N/A | AGGGCCGCGAGGCGGT | 26 | 3635 | 3650 | 2503 |
| 829992 | N/A | N/A | GCAGGGCCGCGAGGCG | 10 | 3637 | 3652 | 2504 |
| 829993 | N/A | N/A | GGCAGGGCCGCGAGGC | 26 | 3638 | 3653 | 2505 |
| 829994 | N/A | N/A | GGAGGCAGGGCCGCGA | 68 | 3641 | 3656 | 2506 |
| 829995 | N/A | N/A | TGGAGGCAGGGCCGCG | 78 | 3642 | 3657 | 2507 |
| 829996 | N/A | N/A | TTTGTCTTAGCTGTGG | 54 | 3662 | 3677 | 2508 |
| 829997 | N/A | N/A | GTTTGTCTTAGCTGTG | 21 | 3663 | 3678 | 2509 |
| 829998 | N/A | N/A | TGTTTGTCTTAGCTGT | 34 | 3664 | 3679 | 2510 |
| 829999 | N/A | N/A | CTGTTTGTCTTAGCTG | 46 | 3665 | 3680 | 2511 |
| 830000 | N/A | N/A | ACTGTTTGTCTTAGCT | 51 | 3666 | 3681 | 2512 |
| 830001 | N/A | N/A | GCCCAACTGTTTGTCT | 24 | 3671 | 3686 | 2513 |
| 830002 | N/A | N/A | TAGCCCAACTGTTTGT | 43 | 3673 | 3688 | 2514 |
| 830003 | N/A | N/A | GGCATTCTTTTAGCCC | 0 | 3683 | 3698 | 2515 |
| 830004 | N/A | N/A | TAAAGGCCCAGCCATG | 24 | 3729 | 3744 | 2516 |
| 830005 | N/A | N/A | CTCACCAGTTGGTTTG | 13 | 3813 | 3828 | 2517 |
| 830006 | N/A | N/A | ACTCACCAGTTGGTTT | 0 | 3814 | 3829 | 2518 |
| 830007 | N/A | N/A | CTACTCACCAGTTGGT | 0 | 3816 | 3831 | 2519 |
| 830008 | N/A | N/A | TAGAGGCTCTATTTCT | 0 | 3865 | 3880 | 2520 |
| 830009 | N/A | N/A | GTGTTAAAGCTGAGCC | 52 | 4073 | 4088 | 2521 |
| 830010 | N/A | N/A | GTCTCAAATGGGCTTC | 68 | 4454 | 4469 | 2522 |
| 830011 | N/A | N/A | CCAGTCTCAAATGGGC | 25 | 4457 | 4472 | 2523 |
| 830012 | N/A | N/A | GCCAGTCTCAAATGGG | 37 | 4458 | 4473 | 2524 |
| 830013 | N/A | N/A | GTGCCAGTCTCAAATG | 55 | 4460 | 4475 | 2525 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830014 | N/A | N/A | GGTGCCAGTCTCAAAT | 22 | 4461 | 4476 | 2526 |
| 830015 | N/A | N/A | GCTGGTGCCAGTCTCA | 56 | 4464 | 4479 | 2527 |
| 830016 | N/A | N/A | GGTGCCCAACCCTTCA | 32 | 4762 | 4777 | 2528 |
| 830017 | N/A | N/A | AGGCGGAAGGACTTGC | 30 | 4797 | 4812 | 2529 |
| 830018 | N/A | N/A | CCCAACAGCCAAAACG | 10 | 4817 | 4832 | 2530 |
| 830019 | N/A | N/A | AGGCCCAACAGCCAAA | 16 | 4820 | 4835 | 2531 |
| 830020 | N/A | N/A | GAAAGGCCCAACAGCC | 23 | 4823 | 4838 | 2532 |
| 830021 | N/A | N/A | GGGAAAGGCCCAACAG | 42 | 4825 | 4840 | 2533 |
| 830022 | N/A | N/A | GGCTGCAGAGTATGGG | 59 | 4909 | 4924 | 2534 |
| 830023 | N/A | N/A | TCACATGCTTTGCGGG | 57 | 5001 | 5016 | 2535 |
| 830024 | N/A | N/A | TGTAAATCGAAAGCAA | 40 | 5021 | 5036 | 2536 |
| 830025 | N/A | N/A | TTTGTAAATCGAAAGC | 62 | 5023 | 5038 | 2537 |
| 830026 | N/A | N/A | TTTTGTAAATCGAAAG | 0 | 5024 | 5039 | 2538 |
| 830027 | N/A | N/A | AACCATTTATCTGGTG | 23 | 5040 | 5055 | 2539 |
| 830028 | N/A | N/A | CAGTCAAGTTACAGTC | 75 | 5131 | 5146 | 2540 |
| 830029 | N/A | N/A | TCACTCCACTCACCGA | 56 | 5439 | 5454 | 2541 |
| 830030 | N/A | N/A | ACCTAATGTCAACACT | 36 | 5473 | 5488 | 2542 |
| 830031 | N/A | N/A | TACCTAATGTCAACAC | 44 | 5474 | 5489 | 2543 |
| 830032 | N/A | N/A | GCTACCTAATGTCAAC | 35 | 5476 | 5491 | 2544 |
| 830033 | N/A | N/A | TCCCCCTTGGAAATGG | 28 | 5533 | 5548 | 2545 |
| 830034 | N/A | N/A | GGCTGATCTGGAGAAC | 30 | 5554 | 5569 | 2546 |
| 830035 | N/A | N/A | ATTGGCTGATCTGGAG | 48 | 5557 | 5572 | 2547 |
| 830036 | N/A | N/A | TATTGGCTGATCTGGA | 52 | 5558 | 5573 | 2548 |
| 830037 | N/A | N/A | CTATTGGCTGATCTGG | 67 | 5559 | 5574 | 2549 |
| 830038 | N/A | N/A | CCTATTGGCTGATCTG | 50 | 5560 | 5575 | 2550 |
| 830039 | N/A | N/A | TTCCTATTGGCTGATC | 51 | 5562 | 5577 | 2551 |
| 830040 | N/A | N/A | CACTTCCTATTGGCTG | 44 | 5565 | 5580 | 2552 |
| 830041 | N/A | N/A | TCACTTCCTATTGGCT | 56 | 5566 | 5581 | 2553 |
| 830042 | N/A | N/A | CAGGTTAATCACTTCC | 64 | 5574 | 5589 | 2554 |
| 830043 | N/A | N/A | TTGGCAGGTTAATCAC | 45 | 5578 | 5593 | 2555 |
| 830044 | N/A | N/A | CGATTGGCAGGTTAAT | 60 | 5581 | 5596 | 2556 |
| 830045 | N/A | N/A | CCGATTGGCAGGTTAA | 47 | 5582 | 5597 | 2557 |
| 830046 | N/A | N/A | TCCGATTGGCAGGTTA | 60 | 5583 | 5598 | 2558 |
| 830047 | N/A | N/A | TTCCGATTGGCAGGTT | 42 | 5584 | 5599 | 2559 |
| 830048 | N/A | N/A | TTTCCGATTGGCAGGT | 57 | 5585 | 5600 | 2560 |
| 830049 | N/A | N/A | GTTTCCGATTGGCAGG | 43 | 5586 | 5601 | 2561 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830050 | N/A | N/A | AGTTTCCGATTGGCAG | 39 | 5587 | 5602 | 2562 |
| 830051 | N/A | N/A | TAGTTTCCGATTGGCA | 84 | 5588 | 5603 | 2563 |
| 830052 | N/A | N/A | GAGTAACCAGCTGTCT | 35 | 5604 | 5619 | 2564 |
| 830053 | N/A | N/A | GGGTGAGTAACCAGCT | 68 | 5608 | 5623 | 2565 |
| 830054 | N/A | N/A | TGGGTGAGTAACCAGC | 48 | 5609 | 5624 | 2566 |
| 830055 | N/A | N/A | TTGGGTGAGTAACCAG | 57 | 5610 | 5625 | 2567 |
| 830056 | N/A | N/A | GTTTTGGGTGAGTAAC | 40 | 5613 | 5628 | 2568 |
| 830057 | N/A | N/A | CGTTTTGGGTGAGTAA | 42 | 5614 | 5629 | 2569 |
| 830058 | N/A | N/A | GGTAGGCACATCATCA | 22 | 6687 | 6702 | 2570 |
| 830059 | N/A | N/A | GGGCCACCCAGTGAGC | 22 | 7617 | 7632 | 2571 |
| 830060 | N/A | N/A | TACCACCCCTGTGAAG | 8 | 7695 | 7710 | 2572 |
| 830061 | N/A | N/A | CTACCACCCCTGTGAA | 4 | 7696 | 7711 | 2573 |
| 830062 | N/A | N/A | CCTACCACCCCTGTGA | 17 | 7697 | 7712 | 2574 |
| 830063 | N/A | N/A | TCCCTACCACCCCTGT | 37 | 7699 | 7714 | 2575 |
| 830064 | N/A | N/A | ATGGTGCTCTGCCCTT | 29 | 7763 | 7778 | 2576 |
| 830065 | N/A | N/A | AATGGTGCTCTGCCCT | 43 | 7764 | 7779 | 2577 |
| 830066 | N/A | N/A | AAATGGTGCTCTGCCC | 37 | 7765 | 7780 | 2578 |
| 830067 | N/A | N/A | GAAATGGTGCTCTGCC | 63 | 7766 | 7781 | 2579 |
| 830068 | N/A | N/A | GTGAAATGGTGCTCTG | 39 | 7768 | 7783 | 2580 |
| 830069 | N/A | N/A | AAGGTAAGCCAGCTCC | 51 | 7808 | 7823 | 2581 |
| 830070 | N/A | N/A | AAAGGTAAGCCAGCTC | 44 | 7809 | 7824 | 2582 |
| 830071 | N/A | N/A | TCAAAGGTAAGCCAGC | 45 | 7811 | 7826 | 2583 |
| 830072 | N/A | N/A | ATCAAAGGTAAGCCAG | 28 | 7812 | 7827 | 2584 |
| 830073 | N/A | N/A | TCAGATCAAAGGTAAG | 41 | 7816 | 7831 | 2585 |
| 830074 | N/A | N/A | CTCAGATCAAAGGTAA | 43 | 7817 | 7832 | 2586 |
| 830075 | N/A | N/A | TCAGGGTGTCAGCCCA | 39 | 7834 | 7849 | 2587 |
| 830076 | N/A | N/A | CACATTCAGGGTGTCA | 43 | 7839 | 7854 | 2588 |
| 830077 | N/A | N/A | CCACATTCAGGGTGTC | 37 | 7840 | 7855 | 2589 |
| 830078 | N/A | N/A | ACCACATTCAGGGTGT | 0 | 7841 | 7856 | 2590 |
| 830079 | N/A | N/A | ATACCCTGCACTTTCT | 22 | 8058 | 8073 | 2591 |
| 830080 | N/A | N/A | TATACCCTGCACTTTC | 32 | 8059 | 8074 | 2592 |
| 830081 | N/A | N/A | GTGTATACCCTGCACT | 0 | 8062 | 8077 | 2593 |
| 830082 | N/A | N/A | GGTGTATACCCTGCAC | 34 | 8063 | 8078 | 2594 |
| 830083 | N/A | N/A | ATGGTGTATACCCTGC | 54 | 8065 | 8080 | 2595 |
| 830084 | N/A | N/A | GATACACTTAATCAAA | 26 | 8124 | 8139 | 2596 |
| 830085 | N/A | N/A | CAGGATACACTTAATC | 27 | 8127 | 8142 | 2597 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830086 | N/A | N/A | TTTACAGGATACACTT | 40 | 8131 | 8146 | 2598 |
| 830087 | N/A | N/A | TTTTACAGGATACACT | 35 | 8132 | 8147 | 2599 |
| 830088 | N/A | N/A | GTTTTACAGGATACAC | 52 | 8133 | 8148 | 2600 |
| 830089 | N/A | N/A | AAGACCCTGTAAGCTT | 9 | 8657 | 8672 | 2601 |
| 830090 | N/A | N/A | ATACACAAGACCCTGT | 10 | 8663 | 8678 | 2602 |
| 830091 | N/A | N/A | AATACACAAGACCCTG | 37 | 8664 | 8679 | 2603 |
| 830092 | N/A | N/A | ATTAGTCCCATGAAAC | 43 | 8683 | 8698 | 2604 |
| 830093 | N/A | N/A | CTCATTAGTCCCATGA | 5 | 8686 | 8701 | 2605 |
| 830094 | N/A | N/A | TCTTACCTGAAAGCCC | 30 | 9717 | 9732 | 2606 |
| 830095 | N/A | N/A | TGAGTAAACAATACCC | 73 | 10899 | 10914 | 2607 |
| 830096 | N/A | N/A | AACAACATCCTGAGCG | 44 | 11118 | 11133 | 2608 |
| 830097 | N/A | N/A | CCATCTAACAACATCC | 68 | 11124 | 11139 | 2609 |
| 830098 | N/A | N/A | AGACAAACCTTCCGAA | 37 | 11236 | 11251 | 2610 |
| 830099 | N/A | N/A | GCCTTTGGAATTAGTA | 79 | 11976 | 11991 | 2611 |
| 830100 | N/A | N/A | GGAGCTCAAACTTTGA | 61 | 11993 | 12008 | 2612 |
| 830101 | N/A | N/A | GCCCGCTCTCAGCCAG | 46 | 12494 | 12509 | 2613 |
| 830102 | N/A | N/A | AGCCCGCTCTCAGCCA | 43 | 12495 | 12510 | 2614 |
| 830103 | N/A | N/A | AAGCCCGCTCTCAGCC | 39 | 12496 | 12511 | 2615 |
| 830104 | N/A | N/A | TAAGCCCGCTCTCAGC | 28 | 12497 | 12512 | 2616 |
| 830105 | N/A | N/A | TTAAGCCCGCTCTCAG | 48 | 12498 | 12513 | 2617 |
| 830106 | N/A | N/A | CATTAAGCCCGCTCTC | 33 | 12500 | 12515 | 2618 |
| 830107 | N/A | N/A | TCATTAAGCCCGCTCT | 50 | 12501 | 12516 | 2619 |
| 830108 | N/A | N/A | TTCATTAAGCCCGCTC | 54 | 12502 | 12517 | 2620 |
| 830109 | N/A | N/A | ATTCATTAAGCCCGCT | 44 | 12503 | 12518 | 2621 |
| 830110 | N/A | N/A | CCATTCATTAAGCCCG | 36 | 12505 | 12520 | 2622 |
| 830111 | N/A | N/A | CCCATTCATTAAGCCC | 38 | 12506 | 12521 | 2623 |
| 830112 | N/A | N/A | GCCCCATTCATTAAGC | 23 | 12508 | 12523 | 2624 |
| 830113 | N/A | N/A | AGCCCCATTCATTAAG | 36 | 12509 | 12524 | 2625 |
| 830114 | N/A | N/A | GAGCCCCATTCATTAA | 22 | 12510 | 12525 | 2626 |
| 830115 | N/A | N/A | ACCCTAAACTGAGCCC | 9 | 12520 | 12535 | 2627 |
| 830116 | N/A | N/A | CACCCTAAACTGAGCC | 11 | 12521 | 12536 | 2628 |
| 830117 | N/A | N/A | CCACCCTAAACTGAGC | 5 | 12522 | 12537 | 2629 |
| 830118 | N/A | N/A | TCCCACCCTAAACTGA | 0 | 12524 | 12539 | 2630 |
| 830119 | N/A | N/A | CCGACCTTCCTCCCAC | 24 | 12534 | 12549 | 2631 |
| 830120 | N/A | N/A | GCCGACCTTCCTCCCA | 27 | 12535 | 12550 | 2632 |
| 830121 | N/A | N/A | AGAATCAAGCCCTGGC | 69 | 12558 | 12573 | 2633 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830122 | N/A | N/A | GAGAATCAAGCCCTGG | 57 | 12559 | 12574 | 2634 |
| 830123 | N/A | N/A | GGCACCACATTTTCAC | 44 | 12612 | 12627 | 2635 |
| 830124 | N/A | N/A | CCGAGGCACCACATTT | 27 | 12616 | 12631 | 2636 |
| 830125 | N/A | N/A | TCCGAGGCACCACATT | 46 | 12617 | 12632 | 2637 |
| 830126 | N/A | N/A | CTCCGAGGCACCACAT | 34 | 12618 | 12633 | 2638 |
| 830127 | N/A | N/A | CCTCCGAGGCACCACA | 62 | 12619 | 12634 | 2639 |
| 830128 | N/A | N/A | ACCTCCGAGGCACCAC | 87 | 12620 | 12635 | 2640 |
| 830129 | N/A | N/A | CACCTCCGAGGCACCA | 41 | 12621 | 12636 | 2641 |
| 830130 | N/A | N/A | CCACCTCCGAGGCACC | 32 | 12622 | 12637 | 2642 |
| 830131 | N/A | N/A | CCCACCTCCGAGGCAC | 68 | 12623 | 12638 | 2643 |
| 830132 | N/A | N/A | TACCCGCCCACTCCCC | 8 | 12739 | 12754 | 2644 |
| 830133 | N/A | N/A | ACAATCTCCTGGAAGC | 26 | 12939 | 12954 | 2645 |
| 830134 | N/A | N/A | AGTACAATCTCCTGGA | 61 | 12942 | 12957 | 2646 |
| 830135 | N/A | N/A | AAGTACAATCTCCTGG | 64 | 12943 | 12958 | 2647 |
| 830136 | N/A | N/A | GAAAGTACAATCTCCT | 64 | 12945 | 12960 | 2648 |
| 830137 | N/A | N/A | ATGAAAGTACAATCTC | 68 | 12947 | 12962 | 2649 |
| 830138 | N/A | N/A | GGAGTTGCATGCCTTT | 71 | 13287 | 13302 | 2650 |
| 830139 | N/A | N/A | TGGAGTTGCATGCCTT | 45 | 13288 | 13303 | 2651 |
| 830140 | N/A | N/A | TCCTAAGCTACTTGGT | 12 | 14096 | 14111 | 2652 |
| 830141 | N/A | N/A | GGCATTAGAGACCTCA | 58 | 14286 | 14301 | 2653 |
| 830142 | N/A | N/A | TGTGCACCAGGTGAGC | 60 | 14548 | 14563 | 2654 |
| 830143 | N/A | N/A | GGTGTGCACCAGGTGA | 62 | 14550 | 14565 | 2655 |
| 830144 | N/A | N/A | GGGTGTGCACCAGGTG | 66 | 14551 | 14566 | 2656 |
| 830145 | N/A | N/A | TGGGTGTGCACCAGGT | 47 | 14552 | 14567 | 2657 |
| 830146 | N/A | N/A | TGGTCTTCACCAGGGT | 62 | 14569 | 14584 | 2658 |
| 830147 | N/A | N/A | GACTGGTCTTCACCAG | 0 | 14572 | 14587 | 2659 |
| 830148 | N/A | N/A | GGACTGGTCTTCACCA | 19 | 14573 | 14588 | 2660 |
| 830149 | N/A | N/A | AGGACTGGTCTTCACC | 47 | 14574 | 14589 | 2661 |
| 830150 | N/A | N/A | CAGTGGTGACCTCCCT | 51 | 16793 | 16808 | 2662 |
| 830151 | N/A | N/A | GCCAGTGGTGACCTCC | 45 | 16795 | 16810 | 2663 |
| 830152 | N/A | N/A | CCCGGAGAGGAAGCCT | 23 | 16878 | 16893 | 2664 |
| 830153 | N/A | N/A | GCCTCAGCAGTTAATA | 21 | 16915 | 16930 | 2665 |
| 830154 | N/A | N/A | GTGCCTCAGCAGTTAA | 48 | 16917 | 16932 | 2666 |
| 830155 | N/A | N/A | TGTGCCTCAGCAGTTA | 38 | 16918 | 16933 | 2667 |
| 830156 | N/A | N/A | CTGTGCCTCAGCAGTT | 48 | 16919 | 16934 | 2668 |
| 830157 | N/A | N/A | GAACTGTGCCTCAGCA | 70 | 16922 | 16937 | 2669 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830158 | N/A | N/A | AATTGAGAACTGTGCC | 43 | 16928 | 16943 | 2670 |
| 830159 | N/A | N/A | CCACTAAATTGAGAAC | 42 | 16934 | 16949 | 2671 |
| 830160 | N/A | N/A | TGGTGTGTTAACCACT | 54 | 16945 | 16960 | 2672 |
| 830161 | N/A | N/A | AGGTGAAAGTTATCAC | 13 | 17276 | 17291 | 2673 |
| 830162 | N/A | N/A | ACAAGGTGAAAGTTAT | 20 | 17279 | 17294 | 2674 |
| 830163 | N/A | N/A | CAACTGAAGGTGACCC | 60 | 17537 | 17552 | 2675 |
| 830164 | N/A | N/A | GCTGCTTGGCCTTACC | 38 | 17627 | 17642 | 2676 |
| 830165 | N/A | N/A | ACAGCTGTACCAGGGC | 58 | 17978 | 17993 | 2677 |
| 830166 | N/A | N/A | CACAGCTGTACCAGGG | 48 | 17979 | 17994 | 2678 |
| 830167 | N/A | N/A | TTTACACACCCCAGGG | 39 | 18337 | 18352 | 2679 |
| 830168 | N/A | N/A | ATGCTTTTACACACCC | 81 | 18342 | 18357 | 2680 |
| 830169 | N/A | N/A | CTCTGTTTGGACAAGT | 58 | 18380 | 18395 | 2681 |
| 830170 | N/A | N/A | GCTCTGTTTGGACAAG | 60 | 18381 | 18396 | 2682 |
| 830171 | N/A | N/A | TGCTCTGTTTGGACAA | 26 | 18382 | 18397 | 2683 |
| 830172 | N/A | N/A | CTGCTCTGTTTGGACA | 27 | 18383 | 18398 | 2684 |
| 830173 | N/A | N/A | AGAGGTGTTTCCAAGG | 48 | 18462 | 18477 | 2685 |
| 830174 | N/A | N/A | GAGAGGTGTTTCCAAG | 49 | 18463 | 18478 | 2686 |
| 830175 | N/A | N/A | TCTCAACAGACCACAC | 44 | 19025 | 19040 | 2687 |
| 830176 | N/A | N/A | ATTCTCAACAGACCAC | 61 | 19027 | 19042 | 2688 |
| 830177 | N/A | N/A | CAGCCCTTTCACCCCT | 40 | 21885 | 21900 | 2689 |
| 830178 | N/A | N/A | ACGACAGCCTGGAGAC | 32 | 21991 | 22006 | 2690 |
| 830179 | N/A | N/A | TTTACTGCATTCCGGC | 51 | 22180 | 22195 | 2691 |
| 830180 | N/A | N/A | CGTGTACCCAGCTGCC | 62 | 23221 | 23236 | 2692 |
| 830181 | N/A | N/A | GCGGCTTCCTGTGCCC | 10 | 23262 | 23277 | 2693 |
| 830182 | N/A | N/A | GTGTCCTTCAGAACAC | 0 | 24168 | 24183 | 2694 |
| 830183 | N/A | N/A | CGGTTGCCTCATCCTG | 47 | 25436 | 25451 | 2695 |
| 830184 | N/A | N/A | ACGGTTGCCTCATCCT | 48 | 25437 | 25452 | 2696 |
| 830185 | N/A | N/A | GCCACCAACGGTTGCC | 27 | 25444 | 25459 | 2697 |
| 830186 | N/A | N/A | AGGTCCAGGGTCCTCC | 50 | 25477 | 25492 | 2698 |
| 830187 | N/A | N/A | ATTACCCTGCTCATGA | 31 | 26595 | 26610 | 2699 |
| 830188 | N/A | N/A | CCACTTAGCAAGGAGC | 50 | 26638 | 26653 | 2700 |
| 830189 | N/A | N/A | TTGGAGCAACACCAGA | 49 | 26813 | 26828 | 2701 |
| 830190 | N/A | N/A | TAATCAGATGCCTGCT | 39 | 26865 | 26880 | 2702 |
| 830191 | N/A | N/A | CTAATCAGATGCCTGC | 47 | 26866 | 26881 | 2703 |
| 830192 | N/A | N/A | ACTAATCAGATGCCTG | 41 | 26867 | 26882 | 2704 |
| 830193 | N/A | N/A | CTTTTCCGGTATTTTC | 35 | 26987 | 27002 | 2705 |

TABLE 9-continued

Inhibition of SMAD7 mRNA expression by 3-10-3 cEt gapmers targeting SEQ ID NO: 1 and 2

| IONIS NO. | SEQ ID: 1 Start Site | SEQ ID: 1 Stop Site | Sequence | % Inhibition | SEQ ID: 2 Start Site | SEQ ID 2: Stop Site | SEQ ID NO. |
|---|---|---|---|---|---|---|---|
| 830194 | N/A | N/A | CCTTTTCCGGTATTTT | 49 | 26988 | 27003 | 2706 |
| 830195 | N/A | N/A | AACCTTTTCCGGTATT | 35 | 26990 | 27005 | 2707 |
| 830196 | N/A | N/A | TTAATGGCCCAGCCCA | 31 | 27613 | 27628 | 2708 |
| 830197 | N/A | N/A | GTTAATGGCCCAGCCC | 31 | 27614 | 27629 | 2709 |
| 830198 | N/A | N/A | AGGCTACACCAAAGAC | 30 | 28194 | 28209 | 2710 |
| 830199 | N/A | N/A | AAGGCTACACCAAAGA | 37 | 28195 | 28210 | 2711 |
| 830200 | N/A | N/A | GAAGGCTACACCAAAG | 33 | 28196 | 28211 | 2712 |
| 830201 | N/A | N/A | CTGAAGGCTACACCAA | 37 | 28198 | 28213 | 2713 |
| 830202 | N/A | N/A | TCTGAAGGCTACACCA | 50 | 28199 | 28214 | 2714 |
| 830203 | N/A | N/A | GCTCTGAAGGCTACAC | 40 | 28201 | 28216 | 2715 |
| 830204 | N/A | N/A | GTATCCATCAACTGCT | 59 | 28269 | 28284 | 2716 |
| 830205 | N/A | N/A | GACTCATCAGGCATTC | 26 | 28300 | 28315 | 2717 |
| 830206 | N/A | N/A | TGACTCATCAGGCATT | 51 | 28301 | 28316 | 2718 |
| 830207 | N/A | N/A | AGGTGACTCATCAGGC | 80 | 28304 | 28319 | 2719 |
| 830208 | N/A | N/A | AAGGTGACTCATCAGG | 57 | 28305 | 28320 | 2720 |
| 830209 | N/A | N/A | ACCGGAAGTCTTGTAT | 31 | 29088 | 29103 | 2721 |
| 830210 | N/A | N/A | GACCGGAAGTCTTGTA | 29 | 29089 | 29104 | 2722 |
| 830211 | N/A | N/A | AGACCGGAAGTCTTGT | 30 | 29090 | 29105 | 2723 |
| 830212 | N/A | N/A | GCAGGGTGGAGACCGG | 43 | 29099 | 29114 | 2724 |

TABLE 10

Inhibition of SMAD7 mRNA expression by 3-10-3 cEt gapmers targeting SEQ ID NO: 3 and 4

| ION NO. | SEQ ID: 3 Start Site | SEQ ID: 3 Stop Site | Sequence | % Inhibition | SEQ ID: 4 Start Site | SEQ ID 4: Stop Site | SEQ ID NO. |
|---|---|---|---|---|---|---|---|
| 790634 | 942 | 957 | AGTCAGTTGGTTTGAG | 0 | N/A | N/A | 2725 |
| 790635 | 946 | 961 | GGACAGTCAGTTGGTT | 40 | N/A | N/A | 2726 |
| 790636 | 953 | 968 | AGCATCTGGACAGTCA | 95 | N/A | N/A | 2727 |
| 799239 | 940 | 955 | TCAGTTGGTTTGAGAA | 16 | N/A | N/A | 2728 |
| 799240 | 950 | 965 | ATCTGGACAGTCAGTT | 45 | N/A | N/A | 2729 |
| 799268 | N/A | N/A | TCCAGTTCGGCCTTCC | 24 | 91 | 106 | 2730 |
| 799269 | N/A | N/A | AGACTCCAGTTCGGCC | 20 | 95 | 110 | 2731 |
| 829940 | 941 | 956 | GTCAGTTGGTTTGAGA | 14 | N/A | N/A | 2732 |
| 829941 | 943 | 958 | CAGTCAGTTGGTTTGA | 8 | N/A | N/A | 2733 |

TABLE 10-continued

Inhibition of SMAD7 mRNA expression by 3-10-3 cEt gapmers targeting SEQ ID NO: 3 and 4

| ION NO. | SEQ ID: 3 Start Site | SEQ ID: 3 Stop Site | Sequence | % Inhibition | SEQ ID: 4 Start Site | SEQ ID 4: Stop Site | SEQ ID NO. |
|---|---|---|---|---|---|---|---|
| 829942 | 952 | 967 | GCATCTGGACAGTCAG | 92 | N/A | N/A | 2734 |
| 829943 | N/A | N/A | GGGAGACTCCAGTTCG | 43 | 98 | 113 | 2735 |

Example 3: Dose-Dependent Antisense-Mediated Inhibition of Human SMAD7 mRNA Expression in Hep3B Cells Antisense oligonucleotides from the studies described above exhibiting significant in vitro inhibition of SMAD7 mRNA expression were selected and tested at various doses in Hep3B cells. The antisense oligonucleotides were tested in a series of experiments that had similar culture conditions as described below.

Study 1

Cells were plated at a density of 20,000 cells per well and transfected using electroporation with 0.31 μM, 1.25 μM, 5.00 μM, or 20.00 μM concentrations of antisense oligonucleotide, as specified in the Tables below. ION 483663 was included in the assays for comparison. After a treatment period of approximately 16 hours, RNA was isolated from the cells and SMAD7 mRNA levels were measured by quantitative real-time PCR. Primer probe set RTS5062 was used to measure human SMAD7 mRNA levels. SMAD7 mRNA levels were adjusted according to total RNA content, as measured by RIBOGREEN®. Results are presented as percent inhibition of SMAD7 mRNA expression, relative to untreated control cells.

The half maximal inhibitory concentration ($IC_{50}$) of each oligonucleotide is also presented. SMAD7 mRNA levels were significantly reduced in a dose-dependent manner in antisense oligonucleotide treated cells.

TABLE 11

% inhibition of SMAD7 mRNA expression

| ION No | 312.5 nM | 1250.0 nM | 5000.0 nM | 20000.0 nM | $IC_{50}$ (μM) |
|---|---|---|---|---|---|
| 278478 | 0 | 9 | 19 | 22 | >20 |
| 483663 | 0 | 0 | 14 | 27 | >20 |
| 771345 | 6 | 19 | 49 | 69 | 6 |
| 771386 | 9 | 3 | 25 | 60 | 19 |
| 771387 | 8 | 13 | 28 | 70 | 10 |
| 771390 | 0 | 12 | 26 | 51 | >20 |
| 771397 | 0 | 0 | 41 | 51 | 15 |
| 771399 | 0 | 6 | 26 | 53 | >20 |
| 771403 | 5 | 4 | 25 | 35 | >20 |
| 771407 | 17 | 0 | 30 | 46 | >20 |
| 771414 | 0 | 2 | 43 | 33 | >20 |
| 771416 | 0 | 3 | 19 | 35 | >20 |
| 771418 | 3 | 0 | 0 | 0 | 6 |
| 771439 | 0 | 24 | 49 | 55 | 9 |
| 771441 | 0 | 5 | 45 | 64 | 9 |
| 771444 | 0 | 0 | 9 | 29 | >20 |
| 771461 | 0 | 2 | 11 | 39 | >20 |
| 771464 | 11 | 8 | 21 | 50 | >20 |
| 771474 | 3 | 4 | 21 | 52 | 17 |
| 771479 | 0 | 8 | 49 | 74 | 7 |
| 771487 | 4 | 0 | 7 | 26 | >20 |

TABLE 11-continued

% inhibition of SMAD7 mRNA expression

| ION No | 312.5 nM | 1250.0 nM | 5000.0 nM | 20000.0 nM | $IC_{50}$ (μM) |
|---|---|---|---|---|---|
| 771492 | 0 | 5 | 32 | 50 | >20 |
| 771506 | 54 | 1 | 5 | 44 | >20 |
| 771509 | 0 | 0 | 13 | 47 | >20 |
| 771539 | 0 | 13 | 7 | 26 | >20 |
| 771552 | 2 | 25 | 20 | 45 | >20 |
| 771555 | 16 | 4 | 4 | 18 | >20 |
| 771556 | 1 | 0 | 9 | 33 | >20 |
| 771570 | 0 | 0 | 43 | 48 | >20 |
| 771572 | 0 | 10 | 38 | 13 | >20 |
| 771573 | 0 | 5 | 24 | 56 | 18 |
| 771574 | 0 | 5 | 36 | 58 | 13 |
| 771576 | 9 | 24 | 55 | 75 | 4 |
| 771579 | 0 | 0 | 46 | 68 | 9 |
| 771581 | 0 | 0 | 9 | 65 | 19 |
| 771583 | 0 | 15 | 36 | 59 | 10 |
| 771610 | 0 | 0 | 37 | 38 | >20 |
| 771611 | 18 | 21 | 47 | 59 | 9 |
| 771632 | 6 | 6 | 46 | 64 | 9 |
| 771634 | 0 | 3 | 40 | 36 | >20 |
| 771636 | 16 | 11 | 33 | 52 | >20 |
| 771636 | 0 | 15 | 33 | 31 | >20 |
| 771636 | 0 | 3 | 34 | 50 | 16 |
| 771636 | 8 | 7 | 27 | 42 | >20 |
| 771636 | 0 | 0 | 2 | 0 | >20 |
| 771641 | 3 | 16 | 24 | 50 | >20 |
| 771661 | 0 | 0 | 6 | 28 | >20 |
| 771663 | 10 | 24 | 43 | 56 | 11 |
| 771670 | 0 | 0 | 21 | 47 | >20 |
| 771671 | 0 | 9 | 27 | 49 | >20 |
| 771691 | 4 | 13 | 33 | 62 | 12 |
| 771699 | 0 | 24 | 48 | 68 | 6 |
| 771704 | 14 | 19 | 30 | 54 | >20 |
| 771705 | 0 | 0 | 0 | 9 | 9 |
| 771711 | 17 | 25 | 27 | 59 | 18 |
| 771715 | 7 | 18 | 42 | 49 | 17 |
| 771717 | 2 | 0 | 0 | 30 | >20 |
| 771732 | 35 | 24 | 39 | 58 | 15 |
| 771733 | 0 | 0 | 26 | 61 | 16 |
| 771734 | 0 | 0 | 30 | 53 | >20 |
| 771737 | 0 | 2 | 0 | 16 | 9 |
| 771742 | 0 | 0 | 0 | 23 | >20 |
| 771762 | 0 | 0 | 38 | 67 | >20 |
| 771769 | 10 | 0 | 3 | 53 | >20 |
| 771770 | 0 | 11 | 27 | 51 | >20 |
| 771773 | 0 | 0 | 0 | 42 | >20 |
| 771776 | 10 | 13 | 36 | 67 | 9 |
| 771777 | 0 | 0 | 27 | 50 | 8 |
| 771778 | 48 | 0 | 37 | 55 | >20 |
| 771782 | 0 | 9 | 27 | 38 | >20 |
| 771786 | 2 | 0 | 53 | 40 | >20 |
| 771788 | 1 | 0 | 0 | 0 | >20 |
| 771793 | 16 | 33 | 38 | 57 | 12 |
| 771794 | 0 | 0 | 27 | 41 | >20 |
| 771795 | 9 | 22 | 51 | 58 | 8 |
| 771797 | 1 | 0 | 15 | 35 | >20 |
| 771799 | 0 | 8 | 28 | 48 | >20 |
| 771808 | 10 | 0 | 23 | 66 | 16 |

TABLE 11-continued

% inhibition of SMAD7 mRNA expression

| ION No | 312.5 nM | 1250.0 nM | 5000.0 nM | 20000.0 nM | IC$_{50}$ (µM) |
|---|---|---|---|---|---|
| 771815 | 0 | 0 | 22 | 46 | >20 |
| 771820 | 3 | 3 | 7 | 7 | >20 |
| 771821 | 0 | 9 | 27 | 46 | >20 |
| 771822 | 0 | 0 | 30 | 45 | >20 |
| 771825 | 15 | 29 | 17 | 66 | 15 |
| 771831 | 0 | 13 | 32 | 51 | 16 |
| 771836 | 6 | 25 | 22 | 41 | >20 |
| 771838 | 0 | 24 | 26 | 43 | >20 |
| 771849 | 25 | 0 | 10 | 35 | >20 |
| 771850 | 0 | 8 | 20 | 44 | >20 |
| 771869 | 10 | 0 | 24 | 43 | >20 |
| 771885 | 0 | 4 | 20 | 45 | >20 |
| 771891 | 0 | 0 | 10 | 33 | >20 |
| 771900 | 0 | 11 | 8 | 29 | >20 |
| 771902 | 0 | 17 | 29 | 59 | 13 |
| 771937 | 0 | 0 | 4 | 41 | >20 |
| 771944 | 0 | 34 | 35 | 48 | >20 |

Study 2

Cells were plated at a density of 20,000 cells per well and transfected using electroporation with 0.74 µM, 2.22 µM, 6.67 µM, or 20.00 µM concentrations of antisense oligonucleotide, as specified in the Tables below. After a treatment period of approximately 16 hours, RNA was isolated from the cells and SMAD7 mRNA levels were measured by quantitative real-time PCR. Primer probe set RTS5062 was used to measure human SMAD7 mRNA levels. SMAD7 mRNA levels were adjusted according to total RNA content, as measured by RIBOGREEN®. Results are presented as percent inhibition of SMAD7 mRNA expression, relative to untreated control cells.

The half maximal inhibitory concentration (IC$_{50}$) of each oligonucleotide is also presented. SMAD7 mRNA levels were significantly reduced in a dose-dependent manner in antisense oligonucleotide treated cells.

TABLE 12

% inhibition of SMAD7 mRNA expression

| ION No | 740 nM | 2220 nM | 6670.0 nM | 20000.0 nM | IC$_{50}$ (µM) |
|---|---|---|---|---|---|
| 771576 | 0 | 23 | 23 | 22 | >20 |
| 772553 | 36 | 45 | 71 | 89 | 2 |
| 772560 | 0 | 32 | 57 | 82 | 5 |
| 772568 | 41 | 62 | 58 | 79 | 1 |
| 772578 | 54 | 44 | 70 | 86 | 1 |
| 772732 | 27 | 60 | 63 | 68 | 3 |
| 772842 | 3 | 23 | 65 | 72 | 6 |
| 772858 | 7 | 26 | 29 | 51 | >20 |
| 790476 | 8 | 38 | 63 | 69 | 5 |
| 790488 | 12 | 34 | 46 | 67 | 7 |
| 790614 | 0 | 29 | 45 | 54 | 11 |
| 790616 | 0 | 8 | 26 | 65 | 13 |
| 790636 | 89 | 93 | 95 | 99 | <0.7 |
| 790666 | 13 | 49 | 54 | 74 | 4 |
| 790732 | 70 | 78 | 88 | 93 | 2 |
| 790736 | 32 | 56 | 68 | 74 | >20 |
| 798662 | 0 | 28 | 22 | 25 | >20 |
| 798686 | 0 | 0 | 2 | 33 | 5 |
| 798687 | 27 | 42 | 60 | 61 | 7 |
| 798696 | 0 | 33 | 58 | 66 | <0.7 |
| 798733 | 58 | 84 | 88 | 95 | 4 |
| 798764 | 19 | 31 | 57 | 93 | 1 |
| 798764 | 42 | 64 | 72 | 87 | 5 |
| 798764 | 29 | 41 | 54 | 65 | 1 |
| 798764 | 43 | 47 | 72 | 83 | 2 |
| 798781 | 46 | 64 | 81 | 87 | 2 |
| 798823 | 27 | 27 | 63 | 70 | >20 |
| 798824 | 0 | 0 | 7 | 42 | 4 |
| 798931 | 0 | 43 | 72 | 83 | 7 |
| 798954 | 4 | 27 | 49 | 70 | >20 |
| 798987 | 0 | 0 | 8 | 47 | 4 |
| 799067 | 5 | 55 | 63 | 78 | 9 |
| 799070 | 0 | 44 | 42 | 60 | 4 |
| 799089 | 12 | 40 | 61 | 76 | 7 |
| 799118 | 0 | 16 | 50 | 75 | <0.7 |
| 799143 | 87 | 93 | 95 | 96 | 2 |
| 799144 | 32 | 50 | 67 | 83 | 2 |
| 799144 | 40 | 57 | 60 | 87 | 1 |
| 799159 | 43 | 55 | 78 | 90 | 19 |
| 799168 | 15 | 13 | 36 | 54 | 5 |
| 799312 | 23 | 46 | 49 | 69 | 4 |
| 799318 | 12 | 40 | 70 | 75 | 11 |
| 799321 | 0 | 5 | 36 | 67 | <0.7 |
| 799322 | 89 | 90 | 96 | 96 | 2 |
| 799364 | 39 | 54 | 67 | 88 | 3 |
| 799365 | 11 | 39 | 73 | 94 | 4 |
| 799366 | 18 | 39 | 64 | 76 | 8 |
| 799369 | 1 | 10 | 46 | 74 | 6 |
| 799382 | 0 | 36 | 56 | 75 | 3 |
| 799396 | 22 | 52 | 72 | 78 | 4 |
| 799396 | 10 | 38 | 70 | 85 | >20 |
| 799402 | 0 | 3 | 13 | 50 | 10 |
| 799404 | 15 | 39 | 42 | 59 | 2 |
| 799406 | 30 | 51 | 77 | 84 | 3 |
| 799410 | 26 | 42 | 64 | 74 | 2 |
| 799412 | 35 | 51 | 67 | 65 | 4 |
| 799429 | 24 | 50 | 60 | 63 | 7 |
| 799467 | 4 | 27 | 65 | 57 | >20 |
| 799471 | 0 | 9 | 14 | 46 | 5 |
| 799486 | 20 | 17 | 57 | 88 | 11 |
| 799496 | 3 | 12 | 34 | 69 | 3 |
| 799509 | 21 | 54 | 69 | 87 | 12 |
| 799511 | 0 | 0 | 35 | 65 | 3 |
| 799534 | 16 | 60 | 51 | 86 | 1 |
| 799540 | 41 | 60 | 63 | 73 | 5 |
| 799543 | 13 | 26 | 61 | 75 | 5 |
| 799544 | 19 | 38 | 54 | 73 | 4 |
| 799556 | 0 | 50 | 71 | 71 | 2 |
| 799563 | 32 | 57 | 85 | 88 | 5 |
| 799564 | 13 | 41 | 60 | 73 | 3 |
| 799565 | 23 | 49 | 67 | 86 | 11 |
| 799566 | 0 | 32 | 63 | 44 | 2 |
| 799566 | 10 | 64 | 82 | 98 | 1 |
| 799568 | 49 | 58 | 84 | 92 | 6 |
| 799572 | 0 | 35 | 62 | 66 | 1 |
| 799577 | 35 | 64 | 75 | 86 | 2 |
| 799583 | 26 | 61 | 73 | 65 | 3 |
| 799583 | 31 | 46 | 59 | 83 | 3 |
| 799589 | 15 | 58 | 77 | 82 | 4 |
| 799596 | 14 | 35 | 66 | 83 | 5 |
| 799605 | 18 | 46 | 51 | 75 | 8 |
| 799607 | 5 | 12 | 46 | 76 | 2 |
| 799608 | 35 | 56 | 70 | 76 | 3 |
| 799624 | 2 | 50 | 77 | 89 | 6 |
| 799631 | 0 | 25 | 49 | 88 | 3 |
| 799663 | 19 | 43 | 61 | 89 | >20 |
| 799667 | 8 | 8 | 17 | 47 | 9 |
| 799668 | 15 | 17 | 39 | 72 | 1 |
| 799669 | 47 | 72 | 82 | 95 | 3 |
| 799671 | 22 | 56 | 71 | 74 | 2 |
| 799673 | 29 | 66 | 74 | 86 | 4 |
| 799674 | 16 | 35 | 64 | 91 | 14 |
| 799686 | 18 | 35 | 36 | 56 | 2 |
| 799689 | 34 | 49 | 65 | 73 | 5 |
| 799708 | 15 | 35 | 52 | 79 | 11 |
| 799709 | 0 | 27 | 36 | 62 | 7 |
| 799711 | 36 | 47 | 51 | 54 | 5 |
| 799712 | 27 | 45 | 55 | 63 | 3 |
| 799718 | 23 | 52 | 66 | 72 | 4 |
| 799722 | 17 | 38 | 53 | 82 | 5 |
| 799734 | 8 | 44 | 64 | 67 | 8 |
| 799743 | 0 | 43 | 44 | 64 | 5 |
| 799751 | 11 | 35 | 69 | 65 | 10 |

TABLE 12-continued

% inhibition of SMAD7 mRNA expression

| ION No | 740 nM | 2220 nM | 6670.0 nM | 20000.0 nM | IC$_{50}$ (µM) |
|---|---|---|---|---|---|
| 799753 | 0 | 33 | 32 | 66 | 4 |
| 799755 | 13 | 44 | 66 | 75 | 6 |
| 799759 | 22 | 44 | 45 | 66 | 2 |
| 799781 | 23 | 75 | 72 | 92 | >20 |
| 799787 | 0 | 9 | 35 | 41 | 18 |
| 799791 | 11 | 4 | 29 | 60 | 6 |
| 799808 | 8 | 33 | 52 | 73 | 10 |
| 799851 | 15 | 36 | 46 | 57 | 2 |
| 799854 | 21 | 56 | 80 | 79 | 5 |
| 799858 | 18 | 43 | 48 | 71 | 2 |
| 799878 | 35 | 64 | 68 | 84 | 17 |
| 799904 | 3 | 9 | 23 | 62 | 8 |
| 799921 | 10 | 35 | 55 | 58 | 11 |
| 799964 | 4 | 15 | 46 | 61 | >20 |
| 799967 | 0 | 0 | 0 | 20 | 9 |
| 799980 | 22 | 22 | 51 | 61 | 13 |
| 800010 | 33 | 13 | 47 | 59 | 6 |
| 800025 | 0 | 42 | 55 | 74 | 6 |
| 800031 | 10 | 39 | 57 | 69 | 8 |
| 800048 | 0 | 31 | 58 | 58 | 4 |
| 800066 | 7 | 42 | 62 | 82 | 9 |
| 800109 | 0 | 10 | 41 | 71 | 1 |
| 800109 | 37 | 64 | 77 | 67 | 1 |
| 800109 | 44 | 57 | 75 | 93 | 1 |
| 800109 | 33 | 62 | 83 | 71 | 1 |
| 800109 | 53 | 69 | 85 | 97 | 1 |
| 801040 | 52 | 55 | 60 | 95 | 1 |
| 801051 | 52 | 62 | 76 | 88 | 4 |
| 829734 | 20 | 40 | 69 | 68 | 4 |
| 829762 | 27 | 41 | 59 | 78 | >20 |
| 829767 | 5 | 6 | 36 | 49 | 3 |
| 829776 | 26 | 40 | 66 | 81 | 5 |
| 829864 | 0 | 33 | 67 | 76 | 1 |
| 829942 | 44 | 70 | 84 | 94 | <0.7 |
| 829956 | 65 | 82 | 89 | 95 | 1 |
| 829980 | 52 | 63 | 79 | 92 | 3 |
| 829994 | 25 | 54 | 69 | 80 | 1 |
| 829995 | 36 | 74 | 76 | 84 | 8 |
| 830010 | 0 | 12 | 52 | 72 | 1 |
| 830025 | 42 | 58 | 72 | 88 | <0.7 |
| 830028 | 54 | 70 | 85 | 93 | 3 |
| 830037 | 30 | 56 | 70 | 87 | 3 |
| 830044 | 47 | 61 | 80 | 93 | 10 |
| 830051 | 0 | 18 | 42 | 67 | 2 |
| 830053 | 29 | 56 | 79 | 87 | 2 |
| 830067 | 23 | 59 | 80 | 88 | 10 |
| 830095 | 3 | 37 | 42 | 60 | 2 |
| 830097 | 29 | 60 | 78 | 86 | 1 |
| 830099 | 42 | 56 | 70 | 92 | 10 |
| 830100 | 3 | 8 | 38 | 69 | 2 |
| 830121 | 37 | 48 | 69 | 85 | <0.7 |
|  | 54 | 63 | 79 | 86 |  |
| 830122 | 28 | 54 | 66 | 74 | 3 |
| 830128 | 20 | 55 | 74 | 85 | 3 |
| 830131 | 34 | 48 | 51 | 61 | 5 |
| 830135 | 16 | 44 | 56 | 71 | 5 |
| 830137 | 19 | 46 | 63 | 84 | 3 |
| 830138 | 0 | 40 | 61 | 87 | 5 |
| 830142 | 13 | 37 | 32 | 49 | >20 |
| 830144 | 47 | 68 | 85 | 96 | 1 |
| 830157 | 24 | 50 | 73 | 81 | 3 |
| 830163 | 33 | 49 | 73 | 84 | 2 |
| 830168 | 31 | 46 | 65 | 73 | 3 |
| 830170 | 1 | 39 | 54 | 67 | 6 |
| 830180 | 21 | 39 | 43 | 64 | 8 |
| 830207 | 49 | 74 | 85 | 93 | 1 |
| 830208 | 38 | 70 | 79 | 90 | 1 |

Example 4: Dose-Dependent Antisense-Mediated Inhibition of Human SMAD7 mRNA Expression in Hep3B Cells The efficacy of select gapmers from the studies described above exhibiting significant in vitro inhibition of SMAD7 mRNA were compared with ION 28453.

Cells were plated at a density of 20,000 cells per well and transfected using electroporation with 0.25 µM, 0.74 µM, 2.22 µM, 6.67 µM, or 20.00 µM concentrations of antisense oligonucleotide, as specified in the Tables below. After a treatment period of approximately 16 hours, RNA was isolated from the cells and SMAD7 mRNA levels were measured by quantitative real-time PCR. Primer probe set RTS5062 was used to measure human SMAD7 mRNA levels. SMAD7 mRNA levels were adjusted according to total RNA content, as measured by RIBOGREEN®. Results are presented as percent inhibition of SMAD7 mRNa expression, relative to untreated control cells.

The half maximal inhibitory concentration (IC$_{50}$) of each oligonucleotide is also presented. SMAD7 mRNA levels were significantly reduced in a dose-dependent manner in antisense oligonucleotide treated cells. Several newly designed antisense oligonucleotides had greater potency than the previously disclosed lead compound, ION 28453.

TABLE 13

% inhibition of SMAD7 mRNA expression

| ION No | 0.25 µM | 0.74 µM | 2.22 µM | 6.67 µM | 20.00 µM | IC$_{50}$ (µM) |
|---|---|---|---|---|---|---|
| 28453 | 0 | 0 | 0 | 2 | 24 | >20 |
| 772568 | 14 | 0 | 25 | 47 | 61 | 9 |
| 798781 | 12 | 38 | 66 | 66 | 87 | 2 |
| 799184 | 0 | 10 | 18 | 51 | 78 | 6 |
| 800821 | 14 | 30 | 35 | 58 | 79 | 4 |
| 800966 | 0 | 0 | 0 | 0 | 0 | >20 |
| 801040 | 31 | 44 | 67 | 63 | 91 | 1 |
| 801051 | 0 | 10 | 34 | 62 | 83 | 4 |
| 823480 | 8 | 0 | 0 | 16 | 26 | >20 |
| 823481 | 11 | 10 | 10 | 32 | 47 | >20 |
| 823486 | 4 | 0 | 0 | 22 | 40 | >20 |
| 823500 | 0 | 0 | 0 | 0 | 0 | >20 |
| 823501 | 0 | 0 | 0 | 9 | 23 | >20 |
| 823667 | 0 | 0 | 2 | 31 | 55 | 18 |
| 823502 | 0 | 0 | 7 | 26 | 41 | >20 |
| 823694 | 0 | 0 | 0 | 0 | 0 | >20 |
| 823503 | 3 | 8 | 8 | 28 | 49 | >20 |
| 772568 | 0 | 0 | 22 | 36 | 61 | 13 |
| 823520 | 0 | 0 | 0 | 3 | 38 | >20 |
| 823525 | 0 | 0 | 0 | 0 | 27 | >20 |
| 823531 | 0 | 0 | 0 | 3 | 23 | >20 |
| 823532 | 1 | 1 | 18 | 42 | 59 | 13 |
| 823584 | 0 | 0 | 14 | 26 | 40 | >20 |

Example 5: Confirmation of Dose-Dependent Antisense-Mediated Inhibition of Human SMAD7 mRNA Expression in A431 Cells The efficacy of select gapmers from the studies described above exhibiting significant in vitro inhibition of SMAD7 mRNA were compared with ION 736697 which has the same sequence and chemistry as GED-0301 (Mongersen) disclosed in WO/2013/037970.

ION 736697 was designed as a uniform deoxy oligonucleotide with sequence GTCGCCCCTTCTCCCCGCAGC (designated herein as SEQ ID NO: 2736), and chemistry Gds Tds mCds Gds Cds Cds Cds Cds Tds Tds Cds Tds Cds Cds Cds mCds Gds Cds Ads Gds Cd, wherein 'd' is deoxy, 's' is phosphorothioate internucleoside linkage, 'mC' is 5-methylcytosine, and 'C', 'T', 'G', and 'A' are the notations of the four nucleobases.

The newly designed compounds disclosed herein are cEt-modified antisense oligonucleotides. Compared with first generation uniform phosphorothioate DNA antisense oligonucleotides, such as ION 736697, cEt-modified antisense oligonucleotides are known to exhibit higher stability leading to increased tissue resident time and uptake, as well as enhanced binding to the target RNA, resulting in increased potency and efficacy. The studies described below show a comparison of select cEt-modified gapmers and ION0736697/Mongersen.

Study 1

A431 cells were plated in collagen I-coated 96-well plates in DMEM with 10% penicillin-streptomycin. Immediately after plating, 0.08 µM, 0.25 µM, 0.74 µM, 2.22 µM, 6.67 µM, or 20.00 µM concentrations of antisense oligonucleotide were added. The plates were shaken briefly before incubating at 37° C. and 10% $CO_2$. After a treatment period of approximately 48 hours, the cells were washed and lyzed and RNA on 384-well Pall plates with DNase I treatment. SMAD7 mRNA levels were measured by quantitative real-time PCR. Primer probe set RTS5062 was used to measure human SMAD7 mRNA levels. SMAD7 mRNA levels were adjusted according to total RNA content, as measured by RIBOGREEN®. Results are presented as percent inhibition of SMAD7 mRNA expression, relative to untreated control cells.

SMAD7 mRNA levels were significantly reduced in a dose-dependent manner in antisense oligonucleotide treated cells. All Ionis oligonucleotides had greater potency than ION 736697/Mongersen. Specifically, both ION 830025 and ION 798781 were more efficacious than ION 736697/Mongersen.

TABLE 14

% inhibition of SMAD7 mRNA expression

| ION No | 0.08 µM | 0.25 µM | 0.74 µM | 2.22 µM | 6.67 µM | 20.00 µM | $IC_{50}$ (µM) |
|---|---|---|---|---|---|---|---|
| 736697 | 14 | 20 | 24 | 13 | 34 | 37 | >20 |
| 790615 | 14 | 43 | 55 | 63 | 70 | 75 | 0.7 |
| 798781 | 23 | 34 | 41 | 41 | 57 | 62 | 3.6 |
| 830025 | 16 | 30 | 22 | 41 | 54 | 67 | 4.7 |
| 830037 | 10 | 31 | 29 | 42 | 61 | 67 | 3.4 |
| 830121 | 11 | 18 | 27 | 21 | 35 | 44 | >20 |

Study 2

Many of the Ionis designed oligonucleotides as well as ION 736697/Mongersen are complementary to mouse Smad7 mRNA. To evaluate the potency of the oligonucleotides in murine cells, bEND cells were transfected using electroporation with 0.25 µM, 0.74 µM, 2.22 µM, 6.67 µM, or 20.00 µM concentrations of antisense oligonucleotide. After a treatment period of approximately 16 hours, the cells were washed and lyzed and RNA on 384-well Pall plates with DNase I treatment. Smad7 mRNA levels were measured by quantitative real-time PCR. Primer probe set RTS1114 (forward sequence CCATCAAGGCTTTTGACTATGAGA, designated herein as SEQ ID NO: 8; reverse sequence CCATGGTTGCTGCATGAACT, designated herein as SEQ ID NO: 9; probe sequence CTACAGCCTGCAGCGGCCCAA, designated herein as SEQ ID NO: 10) was used to measure murine Smad7 mRNA levels. Smad7 mRNA levels were adjusted according to total RNA content, as measured by RIBOGREEN®. Results are presented as percent inhibition of Smad7 mRNA expression, relative to untreated control cells.

SMAD7 mRNA levels were significantly reduced in a dose-dependent manner in antisense oligonucleotide treated cells. Many of the Ionis oligonucleotides had greater potency than ION 736697/Mongersen. Specifically, both ION 830025 and ION 798781 were more potent than ION 736697/Mongersen.

TABLE 15

% inhibition of SMAD7 mRNA expression

| ION No | 0.25 µM | 0.74 µM | 2.22 µM | 6.67 µM | 20.00 µM | $IC_{50}$ (µM) |
|---|---|---|---|---|---|---|
| 736697 | 1 | 1 | 0 | 0 | 0 | >20 |
| 790615 | 7 | 18 | 37 | 47 | 64 | 7.3 |
| 798781 | 0 | 0 | 20 | 33 | 51 | 19.8 |
| 830025 | 15 | 27 | 51 | 67 | 77 | 2.7 |
| 830037 | 0 | 6 | 1 | 0 | 0 | >20 |
| 830121 | 0 | 6 | 12 | 17 | 20 | >20 |

Example 6: Tolerability of 3-10-3 (S)-cEt Gapmers Targeting Human SMAD7 mRNA after Subcutaneous Administration in CD-1 Mice CD-1® mice (Charles River, Mass.) are a multipurpose mice model, frequently utilized for safety and efficacy testing. The mice were treated with Ionis human SMAD7 antisense oligonucleotides selected from studies described above and evaluated.

Treatment

Groups of 8-9 week old male CD-1 mice were injected subcutaneously twice a week for 7 weeks with 50 mg/kg of Ionis oligonucleotides (100 mg/kg/week dose). Each group contained 4 mice. One group of male CD-1 mice was injected subcutaneously twice a week for 7 weeks with PBS. Plasma was collected for analysis on day 28. Mice were euthanized 48 hours after the last dose, and organs and plasma were harvested for further analysis.

Plasma Chemistry Markers

To evaluate the effect of Ionis oligonucleotides on liver and kidney function, plasma levels of transaminases, albumin, and BUN were measured using an automated clinical chemistry analyzer (Olympus AU480 analyzer). The results are presented in the table below. Ionis SMAD7 oligonucleotides that caused changes in the levels of any of the liver or kidney function markers outside the expected range for antisense oligonucleotides were excluded in further studies.

TABLE 16

Plasma chemistry markers in CD-1 mice plasma at day 46

|  | ALT (IU/L) | AST (IU/L) | Albumin (g/dL) | BUN (mg/dL) |
|---|---|---|---|---|
| PBS | 31 | 62 | 2.4 | 23 |
| 790615 | 65 | 97 | 2.2 | 22 |
| 798781 | 40 | 66 | 2.2 | 26 |
| 799144 | 253 | 170 | 2.7 | 21 |
| 829994 | 65 | 90 | 2.9 | 25 |
| 830025 | 208 | 263 | 2.5 | 25 |
| 830027 | 40 | 104 | 2.5 | 23 |
| 830121 | 198 | 151 | 1.9 | 21 |

Organ Weights

Kidney, liver, and spleen weights were measured at the end of the study, and are presented in the table below. Ionis SMAD7 oligonucleotides that caused any changes in organ weights outside the expected range for antisense oligonucleotides were excluded from further studies.

TABLE 17

Organ weights (g)

|  | Kidneys | Liver | Spleen |
|---|---|---|---|
| PBS | 0.6 | 2.2 | 0.2 |
| 790615 | 0.6 | 2.0 | 0.2 |
| 798781 | 0.6 | 2.3 | 0.1 |
| 799144 | 0.6 | 2.3 | 0.1 |
| 829994 | 0.7 | 2.6 | 0.3 |
| 830025 | 0.6 | 2.2 | 0.2 |
| 830027 | 0.6 | 2.6 | 0.2 |
| 830121 | 0.6 | 2.4 | 0.2 |

Hematology Assays

Blood obtained from all mouse groups was measured by an ADVIA2120i hematology analyzer (Siemens, USA) for measurements of the various blood cells, as well as other hematology markers. The results are presented in the tables below. None of the Ionis SMAD7 oligonucleotides caused changes in the levels of any of the hematology markers outside the expected range for antisense oligonucleotides. 'n.d.' indicates that the number was below detection levels.

TABLE 18

Hematology markers in CD-1 mice

|  | RBC ($10^6$/L) | Hemoglobin (g/dL) | Hematocrit (%) | MCV (fL) | MCH (pg) | MCHC (g/dL) | platelets ($10^3$/μL) |
|---|---|---|---|---|---|---|---|
| PBS | 9.2 | 14.7 | 44.9 | 49.0 | 16.0 | 32.8 | 1223.5 |
| 790615 | 10.3 | 15.2 | 46.2 | 44.8 | 14.7 | 32.8 | 1055.8 |
| 798781 | 9.3 | 13.8 | 42.3 | 45.8 | 14.9 | 32.6 | 867.3 |
| 799144 | 9.5 | 14.3 | 43.1 | 45.8 | 15.2 | 33.2 | 614.0 |
| 829994 | 7.7 | 12.0 | 36.6 | 47.3 | 15.5 | 32.7 | 841.3 |
| 830025 | 8.0 | 12.5 | 38.7 | 48.8 | 15.7 | 32.3 | 805.0 |
| 830027 | 9.7 | 14.7 | 44.7 | 46.3 | 15.1 | 32.9 | 1141.8 |
| 830121 | 8.9 | 13.6 | 40.4 | 45.5 | 15.3 | 33.6 | 765.0 |

TABLE 19

Blood cells in CD-1 mice

|  | Reticulocytes (%) | Neutrophils (%) | Lymphocytes (%) | Eosinophils ($10^3$/μL) | Monocytes ($10^3$/μL) | Basophils ($10^3$/μL) | WBC ($10^3$/μL) |
|---|---|---|---|---|---|---|---|
| PBS | 3.6 | 23.0 | 70.2 | 2.2 | 4.3 | 0.2 | 7.7 |
| 790615 | 3.5 | 9.7 | 82.8 | 2.5 | 5.0 | 0.1 | 10.5 |
| 798781 | 3.3 | 18.8 | 73.7 | 2.4 | 5.2 | n.d. | 4.9 |
| 799144 | 3.3 | 11.4 | 80.7 | 2.9 | 4.9 | 0.1 | 6.2 |
| 829994 | 3.7 | 16.4 | 79.4 | 1.3 | 3.0 | n.d. | 5.0 |
| 830025 | 3.3 | 9.3 | 83.2 | 3.8 | 3.2 | 0.6 | 4.8 |
| 830027 | 3.4 | 25.6 | 64.4 | 1.9 | 8.2 | n.d. | 8.6 |
| 830121 | 4.5 | 15.8 | 75.3 | 3.5 | 5.1 | 0.3 | 10.1 |

Oligonucleotide Concentration

Oligonucleotide concentrations in the liver and colon were analyzed using LC-MS/MS method. The data is presented in the Table below.

TABLE 20

| Oligonucleotide concentration (μg/g tissue) | | |
|---|---|---|
| ION No. | Liver | Colon |
| 830121 | 50 | 14 |
| 829994 | 45 | 11 |
| 830037 | 97 | 24 |
| 798781 | 312 | 63 |
| 790615 | 75 | 13 |
| 830025 | 77 | 39 |

Histopathology Evaluations

Liver, kidneys, duodenum, ileum, colon, heart, and lungs were collected from all animals and the intestinal tissues were flushed with 0.9% saline. The tissues were fixed in 10% neutral-buffered formalin, embedded in paraffin, sectioned and stained with hematoxylin and eosin.

Tissues collected from all groups were histologically unremarkable for all mice. Therefore, twice weekly subcutaneous injection of mice with any of the Ionis SMAD7 antisense oligonucleotides at 50 mg/kg for 7 weeks was not associated with any antisense oligonucleotide-related tissue alterations.

Pharmacology

The pharmacological activity of the Ionis oligonucleotides in mice was assessed by measuring mouse Smad7 mRNA expression in liver, kidney, duodenum, ileum, and colon at necropsy.

Tissue samples from all mice were analyzed for Smad7 mRNA expression using the primer probe set HTS7555 (forward sequence CTGACGCGGGAAGTGGAT, designated SEQ ID NO: 2737; reverse sequence TGGCGGACTTGATGAAGATG, designated SEQ ID NO: 2738; probe sequence TGTGGGTTTACAACCGCAGCAGTTACC, designated SEQ ID NO: 2739), which was normalized to mRNA levels of the housekeeping gene, GAPDH. One-way ANOVA with Dunnet's comparison test was used for statistical analysis. The results are presented in the Table below. Treatment with several antisense oligonucleotides, including ION 830025, resulted in significant Smad7 mRNA reduction in various tissues.

TABLE 21

% inhibition of Smad7 mRNA expression (compared to control)

| ION | Kidney | Liver |
|---|---|---|
| 790615 | 23 | 18 |
| 798781 | 18 | 28 |
| 799144 | 3 | 0 |
| 829994 | 73 | 58 |
| 830025 | 45 | 60 |
| 830037 | 7 | 24 |
| 830121 | 0 | 24 |

Example 7: Effect of 3-10-3 (S)-cEt Gapmers Targeting Human SMAD7 mRNA after Oral Administration in CD-1 Mice The objective of this study was to evaluate the tolerability and pharmacodynamics of select Ionis human SMAD7 antisense oligonucleotides in CD-1 mice following 4 weeks of treatment. The mice were administered oligonucleotides by oral gavage.

Treatment

Groups of 7-8 week old male CD-1 mice were given an oral gavage dose once daily for 4 weeks of 500 mg/kg of Ionis SMAD7 oligonucleotides. Each group contained 8 mice. One group of male CD-1 mice was administered saline by oral gavage daily. Mice were euthanized 48 hours after the last dose, and organs and plasma were harvested for further analysis.

Blood Chemistry Markers

To evaluate the effect of Ionis SMAD7 oligonucleotides on liver and kidney function, approximately 0.7 mL of blood samples were collected from the animals and put into tubes without anticoagulant for serum separation. The tubes were kept at room temperature for a minimum of 90 minutes and then centrifuged at 3000 rpm for 10 minutes at room temperature o obtain serum. Levels of transaminases, albumin, and BUN were measured using a Toshiba 200FR NEO chemistry analyzer (Toshiba Co., Japan). The results are presented in the table below. None of the Ionis SMAD7 oligonucleotides caused changes in the levels of any of the liver or kidney function markers outside the expected range for antisense oligonucleotides.

TABLE 22

Plasma chemistry markers in CD-1 mouse plasma at day 30

| | ALT (IU/L) | AST (IU/L) | Albumin (g/dL) | BUN (mg/dL) | Bilirubin (mg/dL) |
|---|---|---|---|---|---|
| PBS | 46 | 77 | 3.4 | 24 | 0.3 |
| 830121 | 45 | 75 | 3.3 | 24 | 0.2 |
| 829994 | 38 | 71 | 3.2 | 25 | 0.3 |
| 830037 | 62 | 94 | 3.3 | 26 | 0.3 |
| 798781 | 43 | 73 | 3.2 | 25 | 0.3 |
| 790615 | 41 | 77 | 3.3 | 22 | 0.3 |
| 830025 | 34 | 65 | 3.3 | 21 | 0.2 |

Body and Organ Weights

Final body weights were measured at the end of the study. There was no significant difference in the body weight of the mice treated with antisense oligonucleotide compared to the control.

Organ weights were also measured at the end of the study, and are presented in the table below. None of the Ionis SMAD7 oligonucleotides caused any changes in organ weights outside the expected range for antisense oligonucleotides.

TABLE 23

Body and organ weights (g)

| | Body | Heart | Kidneys | Spleen | Liver with gallbladder |
|---|---|---|---|---|---|
| PBS | 34 | 0.16 | 0.62 | 0.10 | 1.91 |
| 830121 | 34 | 0.17 | 0.61 | 0.10 | 1.92 |
| 829994 | 35 | 0.18 | 0.62 | 0.11 | 2.02 |
| 830037 | 35 | 0.17 | 0.69 | 0.10 | 1.93 |
| 798781 | 35 | 0.17 | 0.64 | 0.09 | 1.86 |
| 790615 | 35 | 0.17 | 0.64 | 0.11 | 1.88 |
| 830025 | 35 | 0.17 | 0.71 | 0.10 | 1.88 |

Hematology Assays

Blood obtained from all mouse groups was measured by an ADVIA2120i hematology analyzer (Siemens, USA) for measurements of the various blood cells, as well as other hematology markers. The results are presented in the tables below. None of the Ionis SMAD7 oligonucleotides caused changes in the levels of any of the hematology markers outside the expected range for antisense oligonucleotides.

TABLE 24

Hematology markers in CD-1 mice

| | RBC ($10^6$/L) | Hemoglobin (g/dL) | Hematocrit (%) | MCV (fL) | MCH (pg) | MCHC (g/dL) | platelets ($10^3$/µL) |
|---|---|---|---|---|---|---|---|
| PBS | 10.0 | 15.0 | 52.0 | 52.0 | 15.0 | 28.9 | 1108 |
| 830121 | 10.0 | 15.1 | 51.8 | 51.6 | 15.0 | 29.1 | 1170 |
| 829994 | 10.1 | 15.2 | 51.5 | 51.2 | 15.1 | 29.5 | 1219 |
| 830037 | 10.1 | 15.4 | 53.4 | 53.2 | 15.4 | 28.9 | 1122 |
| 798781 | 10.1 | 15.2 | 52.0 | 51.7 | 15.1 | 29.1 | 1099 |
| 790615 | 10.1 | 15.2 | 52.2 | 51.6 | 15.0 | 29.1 | 1033 |
| 830025 | 10.1 | 15.0 | 52.4 | 52.3 | 14.9 | 28.5 | 1236 |

TABLE 25

Blood cells in CD-1 mice

| | Reticulocytes (%) | Neutrophils (%) | Lymphocytes (%) | Eosinophils ($10^3$/µL) | Monocytes ($10^3$/µL) | Basophils ($10^3$/µL) | Leucocytes ($10^3$/µL) | WBC ($10^3$/µL) |
|---|---|---|---|---|---|---|---|---|
| Saline | 3.1 | 12.7 | 81.7 | 0.09 | 0.10 | 0.01 | 0.03 | 4.5 |
| 830121 | 3.0 | 11.6 | 81.7 | 0.08 | 0.15 | 0.01 | 0.03 | 4.1 |
| 829994 | 3.0 | 14.0 | 80.4 | 0.09 | 0.10 | 0.01 | 0.03 | 4.1 |

TABLE 25-continued

Blood cells in CD-1 mice

| | Reticulocytes (%) | Neutrophils (%) | Lymphocytes (%) | Eosinophils ($10^3/\mu L$) | Monocytes ($10^3/\mu L$) | Basophils ($10^3/\mu L$) | Leucocytes ($10^3/\mu L$) | WBC ($10^3/\mu L$) |
|---|---|---|---|---|---|---|---|---|
| 830037 | 3.1 | 19.3 | 73.2 | 0.15 | 0.13 | 0.01 | 0.03 | 4.3 |
| 798781 | 3.0 | 18.0 | 74.0 | 0.26 | 0.18 | 0.02 | 0.04 | 5.7 |
| 790615 | 2.8 | 16.0 | 78.3 | 0.11 | 0.15 | 0.01 | 0.04 | 5.4 |
| 830025 | 3.2 | 17.5 | 77.6 | 0.08 | 0.12 | 0.01 | 0.03 | 4.7 |

Tissue and Organ Evaluation

Histopathology evaluations were performed on the mice treated with Ionis oligonucleotides to evaluate any tissue damage in the liver (with gallbladder), kidneys, heart, spleen, thymus, mesenteric lymph nodes, and different parts of the GI tract, including duodenum, ileum, and colon (proximal and distal). Tissues were collected and fixed in 10% neutral-buffered formalin, embedded in paraffin, sectioned, and stained with hematoxylin and eosin. All the tissues were histologically unremarkable in all mice.

Daily oral gavage of mice with ION 798781, ION 790615, and ION 830025 at a dose of 500 mg/kg for one month was not associated with any antisense oligonucleotide-related tissue alterations.

Oligonucleotide Concentrations

Oligonucleotide concentrations were detected in various tissues by LC-MS/MS analysis. The results are presented below. The greatest concentration was found in the kidney, followed by the colon.

TABLE 26

Oligonucleotide concentration (μg/g)

| | Colon | Duodenum | Ileum | Kidney | Liver |
|---|---|---|---|---|---|
| 830121 | 2.7 | 0.4 | 1.1 | 13.2 | 0.9 |
| 829994 | 5.7 | 0.8 | 4.0 | 9.8 | 1.3 |
| 830037 | 4.8 | 1.2 | 2.7 | 32.4 | 3.9 |
| 798781 | 4.4 | 0.7 | 2.9 | 45.2 | 2.9 |
| 790615 | 2.9 | 0.9 | 1.6 | 23.6 | 2.8 |
| 830025 | 3.6 | 0.7 | 1.9 | 21.5 | 2.3 |

Example 8: Effect of 3-10-3 (S)-cEt Gapmers Targeting Human SMAD7 after Subcutaneous Administration in Beagle Dogs The study was conducted to evaluate the tolerability and pharmacodynamics of human SMAD7 antisense oligonucleotides in beagle dogs. All the antisense oligonucleotides in this study are cross-reactive with dog SMAD7 mRNA.

Treatment

Groups of 24-25 week old male beagle dogs were injected subcutaneously with 30 mg/kg ION Ionis oligonucleotide. There were 4 animals per group. Dogs were injected every two days for the first week (day 1, 3, and 5) and once weekly thereafter (days 8, 15, 22, and 29). A control group of dogs received subcutaneous injections of PBS. Dogs were sacrificed on day 31 approximately 48 hours after the final dose and organs and plasma were harvested for further analysis.

Plasma Chemistry Markers

To evaluate the effect of Ionis SMAD7 oligonucleotides on liver and kidney function, plasma levels of transaminases, albumin, creatine and BUN were measured using an automated clinical chemistry analyzer (Toshiba 200FR Neo chemistry analyzer, Toshiba Co., Japan). The results are presented in the table below. Ionis SMAD7 oligonucleotides that caused changes in the levels of any of the liver or kidney function markers or other plasma chemistry markers outside the expected range for antisense oligonucleotides were excluded in further studies. Specifically, ION 830025 and ION 798781 were well tolerated.

TABLE 27

Plasma chemistry markers in beagle dogs plasma at day 31

| | ALT (IU/L) | AST (IU/L) | Albumin (g/dL) | BUN (mg/dL) | Creatine (mg/dL) | Bilirubin (mg/dL) |
|---|---|---|---|---|---|---|
| PBS | 27 | 40 | 3.0 | 17.1 | 0.7 | 0.2 |
| 830121 | 1454 | 383 | 3.0 | 20.0 | 0.9 | 2.6 |
| 829994 | 62 | 52 | 3.1 | 15.4 | 0.7 | 0.1 |
| 830037 | 3091 | 1132 | 3.7 | 21.2 | 1.0 | 0.8 |
| 798781 | 32 | 45 | 3.0 | 19.4 | 0.9 | 0.2 |
| 790615 | 38 | 41 | 3.4 | 15.7 | 0.8 | 0.2 |
| 830025 | 26 | 38 | 3.1 | 17.9 | 0.9 | 0.1 |

Body and Organ Weights

Body weights as well as kidney, spleen, liver (with gall bladder), mesenteric lymph node, heart, and thymus weights were measured at the end of the study. To control for changes in body weight, results are presented as the organ weight divided by total body weight and then normalized to this result for the PBS control group. Ionis SMAD7 oligonucleotides that caused any changes in organ weights outside the expected range for antisense oligonucleotides were excluded from further studies.

TABLE 28

Body and organ weights (g) in beagle dogs

| | Body | Kidney | Spleen | Liver | Mesenteric LN | Heart | Thymus |
|---|---|---|---|---|---|---|---|
| PBS | 7849 | 37.8 | 24.9 | 260.6 | 10.1 | 63.4 | 9.5 |
| 830121 | 6091 | 40.0 | 27.5 | 202.0 | 12.2 | 52.6 | 2.8 |
| 829994 | 7335 | 39.1 | 22.8 | 250.0 | 9.0 | 57.9 | 6.3 |
| 830037 | 6437 | 36.7 | 23.7 | 204.1 | 9.0 | 51.9 | 6.3 |
| 798781 | 6661 | 40.0 | 26.4 | 242.9 | 7.8 | 53.4 | 6.0 |
| 790615 | 7372 | 44.1 | 32.3 | 253.7 | 10.2 | 63.6 | 9.9 |
| 830025 | 7403 | 40.3 | 28.9 | 250.3 | 10.9 | 60.5 | 8.3 |

Hematology Assays

Blood samples were collected from the cephalic vein or saphenous vein of each animal. About 0.5 mL of blood samples was put into tubes containing the potassium salt of EDTA. Blood obtained from all dog groups was measured using an ADVIA2120i hematology analyzer for measurements of the various blood cells, as well as other hematology markers. The results are presented in the tables below. Ionis SMAD7 oligonucleotides that caused changes in the levels of any of the hematology markers outside the expected range for antisense oligonucleotides were excluded in further studies.

TABLE 29

Hematology markers in Beagle Dogs

|  | RBC (^6/L) | Hemo-globin (g/dL) | Hemat-ocrit (%) | MCV (fL) | MCH (pg) | MCHC (g/dL) | PLT (^3/μL) | WBC (^3/μL) |
| --- | --- | --- | --- | --- | --- | --- | --- | --- |
| PBS | 6.8 | 16.5 | 46 | 67 | 24.3 | 36.1 | 271 | 9.4 |
| 830121 | 8.5 | 18.5 | 56 | 66 | 21.7 | 32.9 | 249 | 8.2 |
| 829994 | 6.6 | 15.3 | 44 | 66 | 23.2 | 35.1 | 287 | 12.5 |
| 830037 | 8.0 | 17.5 | 52 | 66 | 22.1 | 33.6 | 280 | 8.5 |
| 798781 | 7.3 | 16.2 | 48 | 67 | 22.3 | 33.6 | 191 | 7.3 |
| 790615 | 6.6 | 14.5 | 45 | 68 | 21.9 | 32.5 | 242 | 7.1 |
| 830025 | 6.4 | 13.9 | 43 | 67 | 21.7 | 32.5 | 250 | 5.7 |

TABLE 30

Blood cells in Beagle Dogs

| ION No | Reticulocytes (%) | Neutrophils (%) | Lymphocytes (%) | Eosinophils (%) | Monocytes (%) | Basophils (%) |
| --- | --- | --- | --- | --- | --- | --- |
| PBS | 0.9 | 56 | 35 | 2.6 | 5.7 | 0.6 |
| 830121 | 0.5 | 59 | 30 | 2.5 | 7.7 | 0.8 |
| 829994 | 0.9 | 65 | 26 | 1.8 | 6.3 | 0.5 |
| 830037 | 0.3 | 57 | 32 | 2.6 | 8.0 | 0.7 |
| 798781 | 0.6 | 56 | 34 | 2.7 | 6.5 | 0.5 |
| 790615 | 0.7 | 53 | 36 | 2.6 | 7.9 | 0.5 |
| 830025 | 1.2 | 55 | 34 | 2.4 | 8.2 | 0.3 |

Oligonucleotide Concentration Analysis

Oligonucleotide concentrations of both ION 830025 and ION 798781 were detected in various tissues by LC-MS/MS analysis. The results are presented below, expressed as μg/g tissue. The data was collected 48 hours after the last dose.

TABLE 31

Full length oligonucleotide (μg/g)

|  | Liver | Duodenum | Ileum | Distal colon | Proximal colon | Kidney |
| --- | --- | --- | --- | --- | --- | --- |
| 830121 | 443 | 26 | 26 | 20 | 19 | 1468 |
| 829994 | 335 | 23 | 12 | 7 | 11 | 894 |
| 830037 | 521 | 55 | 67 | 46 | 86 | 894 |
| 798781 | 964 | 97 | 177 | 68 | 73 | 3300 |
| 790615 | 220 | 17 | 18 | 17 | 17 | 1156 |
| 830025 | 466 | 97 | 41 | 49 | 31 | 1470 |

Tissue and Organ Evaluation

Histopathology evaluations were performed on the dogs treated with Ionis oligonucleotides to evaluate any tissue damage in the liver (with gallbladder), kidneys, heart, spleen, thymus, mesenteric lymph nodes, and different parts of the GI tract, including duodenum, ileum, and colon (proximal and distal). Tissues were collected and fixed in 10% neutral-buffered formalin, embedded in paraffin, sectioned, and stained with hematoxylin and eosin. Antisense oligonucleotide-related lesions in treated dogs were generally within the typical spectrum expected for antisense oligonucleotides at high tissue concentrations.

Pharmacology

The pharmacological activity of the Ionis oligonucleotides in dogs was assessed by measuring dog SMAD7 mRNA expression in liver, kidney, duodenum, ileum, and colon at necropsy. All the human ASOs used are complementary to dog SMAD7 mRNA.

Tissue samples from all dogs were analyzed for SMAD7 mRNA expression using the primer probe set RTS34649 (forward sequence CCGATGGATTTTCTCAAACCA, designated SEQ ID NO: 2740; reverse sequence AATTCGTTCCCCCTGTTTCAG, designated SEQ ID NO: 2741; probe sequence ACTGTCCAGATGCTGTGCCTTCCTCC, designated SEQ ID NO: 2742), which was normalized to mRNA levels of the housekeeping gene, HPRT1. One-way ANOVA with Dunnet's comparison test was used for statistical analysis. The results are presented in the Table below.

TABLE 32

% inhibition of SMAD7 mRNA expression (compared to control)

| ION | Kidney | Liver | Duodenum | Ileum | Proximal colon | Distal colon |
| --- | --- | --- | --- | --- | --- | --- |
| 830121 | 39 | 0 | 55 | 0 | 20 | 21 |
| 829994 | 0 | 0 | 2 | 32 | 34 | 29 |
| 830037 | 40 | 0 | 33 | 22 | 50 | 22 |
| 798781 | 28 | 0 | 0 | 0 | 26 | 34 |
| 790615 | 37 | 9 | 35 | 0 | 41 | 31 |
| 830025 | 25 | 0 | 7 | 9 | 24 | 3 |

Example 9: Evaluation of 3-10-3 cEt Gapmers Targeting Human SMAD7 in Human PBMC Activation Assay Human peripheral blood mononuclear cells (PBMCs) can be stimulated by various means to produce specific cytokines. Ionis SMAD7 oligonucleotides were tested in an in vitro assay for potential immunostimulatory properties in an in vitro human peripheral blood mononuclear cell (PBMC) activation assay.

Treatment

Blood samples were collected from healthy human volunteers in heparinized vials and mixed well. Human PBMCs were isolated by gradient centrifugation using Ficoll-Histopaque. The cells were washed, counted and resuspended in medium. The PBMCs were plated in a 24-well culture plate and various concentrations of oligonucleotides were added to the media. An oligonucleotide historically known to promote an inflammatory response was used as a positive control, whereas an oligonucleotide known not to be pro-inflammatory was used as a negative control. ION 736697/Mongersen was also included in this assay. The supernatants were collected after 24 hours and analyzed for cytokine levels using MSD platform. The results are presented in the Table below and demonstrate that Ionis SMAD7 oligonucleotides have a more favorable profile than ION 736697/Mongersen in this PBMC assay. Specifically, ION 830025 elicited minimal cytokine and chemokine production which was similar or less than the negative control ASO.

TABLE 33

Levels of IL-10 (pg/ml)

|  | 0 μM | 0.0128 μM | 0.064 μM | 0.32 μM | 1.6 μM | 8 μM | 40 μM | 200 μM |
|---|---|---|---|---|---|---|---|---|
| (−) control | 0.9 | 1.1 | 1.9 | 2.8 | 1.8 | 1.3 | 1.4 | n.d. |
| 830121 | 1.2 | 2.0 | 1.3 | 1.3 | 3.1 | 3.7 | 2.2 | 1.4 |
| 830025 | 1.4 | 1.5 | 1.9 | 2.6 | 3.6 | 2.9 | 1.4 | 0.7 |
| 829994 | 2.0 | 2.0 | 1.8 | 1.8 | 5.2 | 8.0 | 4.3 | 3.8 |
| 830037 | 0.8 | 1.6 | 3.2 | 8.2 | 9.5 | 7.1 | 4.7 | 3.8 |
| 798781 | 1.1 | 2.2 | 2.0 | 2.3 | 3.9 | 2.9 | 1.4 | 0.6 |
| 790615 | 2.4 | 1.1 | 1.6 | 2.4 | 3.1 | 1.9 | 0.8 | 0.7 |
| 736697 | 1.2 | 2.1 | 3.1 | 3.5 | 2.2 | 4.2 | 4.7 | 4.0 |
| ION 736697/Mongersen | 1.2 | 2.1 | 3.1 | 3.5 | 2.2 | 4.2 | 4.7 | 4.0 |
| (+) control | 1.1 | 2.7 | 16.6 | 24.4 | 17.2 | 6.3 | 4.3 | 4.2 |

TABLE 34

Levels of IL-6 (pg/ml)

|  | 0 μM | 0.0128 μM | 0.064 μM | 0.32 μM | 1.6 μM | 8 μM | 40 μM | 200 μM |
|---|---|---|---|---|---|---|---|---|
| (−) control | 9.3 | 4.4 | 5.5 | 7.3 | 9.6 | 13.6 | 24.9 | n.d. |
| 830121 | 3.3 | 4.1 | 4.9 | 4.4 | 5.4 | 7.5 | 14.3 | 35.2 |
| 830025 | 3.8 | 3.1 | 3.8 | 5.0 | 12.9 | 17.8 | 19.5 | 30.6 |
| 829994 | 3.6 | 4.1 | 3.8 | 4.5 | 15.9 | 202.5 | 66.1 | 97.1 |
| 830037 | 3.4 | 3.8 | 9.8 | 26.7 | 38.6 | 38.4 | 58.7 | 71.2 |
| 798781 | 3.6 | 3.4 | 4.9 | 6.9 | 12.3 | 18.1 | 20.7 | 28.0 |
| 790615 | 4.2 | 3.7 | 3.8 | 6.5 | 9.0 | 10.0 | 11.0 | 22.9 |
| 736697 | 3.7 | 3.6 | 5.3 | 12.3 | 15.5 | 57.4 | 63.3 | 64.8 |
| ION 736697/Mongersen | 3.7 | 3.6 | 5.3 | 12.3 | 15.5 | 57.4 | 63.3 | 64.8 |
| (+) control | 3.7 | 8.7 | 85.1 | 122.7 | 124.5 | 91.7 | 98.4 | 89.5 |

TABLE 35

Levels of MCP-1 (pg/ml)

|  | 0 μM | 0.0128 μM | 0.064 μM | 0.32 μM | 1.6 μM | 8 μM | 40 μM | 200 μM |
|---|---|---|---|---|---|---|---|---|
| (−) control | 50.1 | 337.6 | 461.2 | 440.6 | 422.3 | 591.5 | 398.6 | n.d. |
| 830121 | 269.1 | 324.5 | 370.4 | 336.4 | 501.8 | 717.1 | 1225.2 | 411.0 |
| 830025 | 277.3 | 309.7 | 353.9 | 387.7 | 554.3 | 750.0 | 580.8 | 52.7 |
| 829994 | 262.5 | 299.8 | 379.8 | 489.7 | 1300.0 | 3370.0 | 1998.4 | 391.7 |
| 830037 | 222.3 | 369.4 | 557.1 | 1284.2 | 1085.9 | 1917.1 | 3414.8 | 2449.3 |
| 798781 | 289.2 | 332.9 | 387.0 | 483.1 | 597.2 | 582.7 | 565.8 | 61.3 |
| 790615 | 238.1 | 329.5 | 281.8 | 424.3 | 495.8 | 449.0 | 301.9 | 81.6 |
| 736697 | 268.5 | 297.6 | 385.9 | 681.3 | 693.9 | 2306.8 | 2974.9 | 622.8 |
| ION 736697/Mongersen | 268.5 | 297.6 | 385.9 | 681.3 | 693.9 | 2306.8 | 2974.9 | 622.8 |
| (+) control | 296.9 | 523.8 | 963.3 | 1623 | 1638.6 | 997.6 | 1775.1 | 516.8 |

TABLE 36

Levels of TNF-α (pg/ml)

|  | 0 μM | 0.0128 μM | 0.064 μM | 0.32 μM | 1.6 μM | 8 μM | 40 μM | 200 μM |
|---|---|---|---|---|---|---|---|---|
| (−) control | 2.1 | 2.5 | 3.3 | 3.5 | 4.1 | 6.6 | 7.9 | n.d. |
| 830121 | 3.2 | 3.0 | 3.5 | 3.1 | 3.6 | 4.8 | 9.4 | 14.2 |
| 830025 | 3.0 | 2.8 | 2.9 | 3.9 | 5.4 | 6.7 | 7.6 | 4.9 |
| 829994 | 2.8 | 2.5 | 2.9 | 3.0 | 8.0 | 63.2 | 32.3 | 28.6 |
| 830037 | 2.4 | 3.2 | 4.1 | 8.2 | 9.2 | 11.1 | 16.6 | 18.9 |
| 798781 | 3.1 | 2.6 | 3.3 | 3.8 | 5.1 | 6.5 | 6.3 | 4.0 |
| 790615 | 2.7 | 3.1 | 2.5 | 3.4 | 4.2 | 4.8 | 4.8 | 4.8 |
| 736697 | 2.8 | 2.8 | 3.5 | 5.5 | 6.8 | 13.6 | 28.1 | 43.7 |
| ION 736697/Mongersen | 2.8 | 2.8 | 3.5 | 5.5 | 6.8 | 13.6 | 28.1 | 43.7 |
| (+) control | 2.6 | 4.9 | 12.1 | 13.3 | 14.5 | 14.9 | 20.5 | 28.7 |

Example 10: Efficacy of 3-10-3 (S)-cEt Gapmers Targeting Human SMAD7 after Subcutaneous Administration in BALB/c Mice The objective of this study was to evaluate the efficacy of Ionis SMAD7 antisense oligonucleotides compared to ION 736697/Mongersen in BALB/c mice following 4 weeks of treatment. Both ION 830025 and ION 798781 are cross-reactive with mouse Smad7 mRNA.

Treatment

Groups of BALB/c mice were subcutaneously administered 50 mg/kg of Ionis SMAD7 oligonucleotides once a week for 4 weeks. Each group contained 4 mice. One group of mice was administered PBS once a week for 4 weeks. Mice were euthanized 24 hours after the last dose, and organs and plasma were harvested for further analysis.

RNA Analysis

To evaluate the efficacy of the oligonucleotides, murine Smad7 mRNA expression in the liver and the colon was measured. The results are presented below and demonstrate that all the Ionis SMAD7 oligonucleotides tested were more efficacious than the ION 736697/Mongersen in reducing mouse Smad7 mRNA expression in the liver and GI segments.

TABLE 37

| Mouse Smad7 mRNA expression (% inhibition) | | | | | |
|---|---|---|---|---|---|
| | Liver | Kidney | Duodenum | Ileum | Colon |
| ION 830025 | 46 | 5 | 26 | 14 | 32 |
| ION 790615 | 47 | 28 | 39 | 41 | 71 |
| ION 798781 | 36 | 11 | 27 | 22 | 41 |
| ION 736697/Mongersen | 6 | 9 | 0 | 0 | 3 |

Example 11: Efficacy of 3-10-3 (S)-cEt Gapmers Targeting Human SMAD7 after Oral Administration in BALB/c Mice The objective of this study was to evaluate the efficacy of Ionis SMAD7 antisense oligonucleotides in BALB/c mice following daily oral administration. The Ionis oligonucleotides are cross-reactive with mouse Smad7 mRNA.

Treatment

Groups of BALB/c mice were orally administered 500 mg/kg/day for 3 weeks of human Smad7 oligonucleotides, ION 790615, ION 798781, or ION 830025, or mouse Smad7 oligonucleotide, ION 772797 (a 3-10-3 cEt gapmer with phosphorothioate backbone and sequence AATGAACTGTATCTCC; designated herein as SEQ ID NO: 2743). One group of mice was orally administered PBS daily for 3 weeks. Each group contained 4 mice. Mice were euthanized 24 hours after the last dose, and organs and plasma were harvested for further analysis.

RNA Analysis

To evaluate the efficacy of the oligonucleotides, murine Smad7 mRNA expression in the liver, kidneys, duodenum, ileum, and colon was measured using primer probe set RTS1114. The results are presented below. The data demonstrate that ION 830025 was efficacious in reducing Smad7 mRNA expression.

TABLE 38

| Mouse Smad7 mRNA expression (% inhibition) | | | | | |
|---|---|---|---|---|---|
| | Liver | Kidney | Duodenum | Ileum | Colon |
| 772797 (mouse ASO) | 7 | 0 | 36 | 8 | 1 |
| 798781 (human ASO) | 0 | 12 | 47 | 0 | 0 |
| 790615 (human ASO) | 52 | 41 | 54 | 0 | 72 |
| 830025 (human ASO) | 25 | 31 | 51 | 0 | 39 |

Example 12: Effect of 3-10-3 (S)-cEt Gapmers Targeting Human SMAD7 after Oral Administration in Beagle Dogs The study was conducted to evaluate the tolerability and pharmacodynamics of select human SMAD7 antisense oligonucleotides in beagle dogs following 4 weeks of treatment. The dogs were administered oligonucleotides by oral gavage.

Treatment

Groups of 24-25 week old male beagle dogs were administered 200 mg Ionis human SMAD7 oligonucleotide by oral gavage once a week for 4 weeks. There were 4 animals per group. A control group of dogs received oral administration of distilled water. Dogs were sacrificed on day 30 approximately 48 hours after the final dose and organs and plasma were harvested for further analysis.

Plasma Chemistry Markers

To evaluate the effect of Ionis SMAD7 oligonucleotides on liver and kidney function, approximately 1.5 mL of blood samples were collected and put into tubes without anticoagulant for serum separation. The tubes were kept at room temperature for a minimum of 90 min and then centrifuged (approximately 3,000 rpm for 10 min) to obtain serum. Plasma levels of transaminases, albumin, bilirubin, and BUN were measured using an automated clinical chemistry analyzer (Toshiba 200FR Neo chemistry analyzer, Toshiba Co., Japan). The results are presented in the table below. The results indicate that Ionis SMAD7 oligonucleotides did not cause any changes in the levels of plasma chemistry markers outside the expected range for antisense oligonucleotides. Specifically, ION 830025 and ION 798781 were very well tolerated.

TABLE 39

| Plasma chemistry markers (% of control) in beagle dog plasma at day 30 | | | | | |
|---|---|---|---|---|---|
| | Albumin | ALT | AST | BUN | Bilirubin |
| Control | 100 | 100 | 100 | 100 | 100 |
| 830025 | 96 | 117 | 106 | 93 | 96 |
| 798781 | 101 | 115 | 114 | 104 | 114 |
| 790615 | 98 | 118 | 147 | 108 | 102 |

Organ Weights

The weights of liver, kidney, and spleen were measured after terminal sacrifice and the results are presented in the table below. The results indicate that Ionis SMAD7 oligonucleotides did not cause any changes in the organ weights outside the expected range for antisense oligonucleotides. Specifically, ION 830025 and ION 798781 were very well tolerated.

TABLE 40

Organ weights (% of control) in beagle dogs at day 30

|  | Liver | Kidney | Spleen |
|---|---|---|---|
| Control | 100 | 100 | 100 |
| 830025 | 79 | 99 | 87 |
| 798781 | 91 | 86 | 102 |
| 790615 | 85 | 94 | 106 |

Histopathology

Liver (with gall bladder), kidneys, spleen, heart, thymus, duodenum, ileum, colon (distal and proximal), stomach, mesenteric lymph nodes and gut-associated lymph nodes (GALT) were collected from all animals and the intestinal tissues were flushed with 0.9% saline. The tissues were fixed in 10% neutral-buffered formalin, embedded in paraffin, sectioned and stained with hematoxylin and eosin.

Tissues collected from control animals exhibited typical spontaneous background alterations common in dogs of this age. The dogs orally administered Ionis SMAD7 oligonucleotides had no oligonucleotide-related tissue alterations. Therefore, all three oligonucleotides were very well tolerated.

Pharmacokinetics

Canine tissue exposure following oral administration of the Ionis SMAD7 oligonucleotides was measured in various organs and intestinal tissues. The results are presented below. The data indicates that tissue accumulation was the greatest in the kidney, followed by the liver, duodenum, ileum, and proximal colon. Distal colon accumulation was detected in dogs administered ION 830025.

Plasma concentrations of Ionis oligonucleotides were also measured on Day 28 at various time points. The results are presented in the Table below. Both the oligonucleotides had comparable accumulation in the GI tract, with ION 798781 showing higher accumulation in the liver and kidneys.

TABLE 41

Oligonucleotide concentration in tissues (µg/g)

|  | ION 830025 | ION 798781 |
|---|---|---|
| Kidney | 48.1 | 108.1 |
| Liver | 7.8 | 12.9 |
| Duodenum | 0.8 | 0.6 |
| Ileum | 0.3 | 0.5 |
| Proximal colon | 0.2 | 0.1 |
| Distal colon | 0.1 | n.d. |

TABLE 42

Oligonucleotide concentration in the plasma on day 28 (ng/mL)

|  | 830025 | 798781 | 790615 |
|---|---|---|---|
| 2 hr | 13.6 | 18.7 | 16.7 |
| 4 hr | 3.8 | 5.4 | 4.8 |
| 8 hr | 1.7 | 3.6 | 0.5 |
| 24 hr | 0.0 | 0.4 | 0.0 |

SEQUENCE LISTING (2743 sequences)

SEQ ID NO: 1 - DNA, 3088 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 2 - DNA, 34001 bp, Homo sapiens
gaggccggagccgggcgcgccactgcgcagtggaaccagccgagcagagggccggagggggggtgcgggggggcggggaggaggcggcgcggctgcggcggctgggggcgggggagggaagggggaggaagggggagggaagggggcgggggcgggaggccttgcgggaggcggtgagccccgggcacactcgcttgctgctcggcgcacggaagatcctgtccccgagccgcgccagccgagccagccgggcgccgtgctcggtccgctcgccgcgcgggagagagctgcccgagacagagccagtccgtcggcgccgagccgccgagcgcccggcccctgagcccctgagtgcggcgcggcgagcccctggcggcggcagaaggaccggagcgccaggagagggcggaccggggacaaggaggctcccgggcgcgacgaggagagtctcggaggaggaggcgccgagaggacaccggggcctcctgccgccgcagctgggtcgaggcgagcagcccatgcggggagcctcggcggccagccgcggccaggggaagggacatcggcggcccctgcactagcaagcagcttgtgcccggggggggcgagaacgcgcgacccgtctggggccctccgccgccgccgcgccaccctcccccgcgctgtcagccccgccgggctcagccgccgccgcagcatcttctgcccctgcgcccgcgccagcctcgaggaagtccccgccgaggacctgggcccccaggagcgcagggggaaagaccagagactcccctaaaccacccagatgcgcaggattgaagcggtctagccaaagctttctgtggattaaaaaaatacacgatttttttttttttttttggcagaagaaaaggagaggaagaccagcggggctttgcaaggaaacggggggatgtaactcgtggatacatttttccacccatcaaacatcttgttatactttgtaaacattttctttttttaaaccccagttccagccggacgcccccagacctctgaggttcgaggaggtggtggttttcatttggggctttgcatatttggttgttaggttttgcgagagccttcttattttgccagacgtctcatgcggggtgaagtccactcggccccctcccctgagtcttcgtgtgcgcggaattcgaggagatccggttactaaggatatagaggaaaaaaataaatcgcttgcttttttttttttaattgcctgcttctccccacccccaaattaagttgcttagcaagggggaaagaggctttttccttcttccaacagcccagccgaacgcctttcgttttttgcccccgcggaccttccatgtaggaagccgaggctggcgagcccgacattcgggagccactgcgggggggcctctttttggggaggcgccgacgggggcaggctcggccgtccccagggaagcggcggccgggttcctccggggcgcgccggggccggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactaggtgagaagttgtccccctacccccaacattttccggagcgccagtgctggaagaaaagcccctagggcagtgcgtttgtgcagccatccctccagggggagtgtgcataccctcctgggagagtgtgcataccctcctgggagagtgtgcataccctcctgggaagagactgggggctgaaagtagagaagggacaaggggaaactcaaagggcattccctgggggttcccttccaggttttctcctgtgttgccccgaaggggtctacgggcactgctcctgcagtctgcggttaaaaattagacgccttcatttccggatcaacaagggggtgcagagggaggtgggggggtcacgcctccccgcacccggaaagacgttgaggtgtgtggccgagttggatttggtccaggcccgccaaggaaggctgggagaggcgtgctataaaggctggaaggtctccgtatttactcctttagtaaatacggagaatcacgtcgaacaccagtggcccagatactgtcgtggccgcgcacctttggagttttggggcaaagagagttggatggaaggccgaactgggtatctgtctcctttcaactctgccagccccagggtgcagaggaacaaacaggcaggagaagttgggtgtcccctactttttccttccttccgcacagataagtctgtagattagtggggccccggcgcctcagtgacgttgtcgcctcttactgcgctggggcctgggcttctcggctgagaccctgaaactcctttccttttatcctctcagctttctccattccttcctttactctacgtctctgtacacagagtgtgatgtgagggttcaccccgggcgcccgcagatcccccacgttccccagcacgcttgggatgcatctcccgagtgcgctaggaatgggcagccccgtgtcccccgcgcgagtgccgagcggaccggcgggggcagaggtgaattgcacgcctggggggcgggccggggcggggagccgaggttgctgggagctgggtctggagtccgaggacggggagggggcatggtcgccccccgccctgtgaactgtgaagtgcgcggctccggccgagccggtggtttccagccgggccagccgagcgcggcggctgcggccgcagacgtggaggagcggagcgccgaggctggcgccaggcggcctcttttgtttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccgatggattttctcaaaccaactggtgagtagatgatttttaaaatatcctgcttatcttaagttagaaatagagcctctagaacgtggctttttgtgtgtaggcaaaggcttggggaggtgctgggcttcacgttggttctaggtttcctctgttggaagtttggtgaatttttctgttgtggctgggttttttgctgtttttgcaaagacgttcccttgatatgctttacattttgttcctttttcatgtatttgtgctgtgtagccggtgggctcagctttaacacgtggaagctttagtccagagagaagtgtcttgggaaccaaataggactggttgatggggataactcggagacttagtgagtgccaggagcatcagtgggaataatggaaagggtgattcgatagatgggaagacggtttaaaaaggtgcaaagaagactttggtctggagtagacactagaacttttcagaagtataggcaacagccagtaaaaggggggggggggtaggttcctcctgctccagtcacctgcaagtcagtcctctcccggggttttctcagtattcgccatagggactatcaaagtttgaagcatagctctgcctgtctgctgctttgtcactggctggcatgaagccatggcagaagcccatttgagactggcaccagccctgttgtggttgtctgcattcaacttctggccggcagcagcacaggggtccatcctctggacatcacagtgctggggacagggtcagcaaaatgaacttgggggtgacaacaaggacaaacccaaattcctggagctccctcttacagtaggagatagatctgtttgctaaaagtacaggttgtatgtaaccttggtttttgtgcctgtatactggtgcctgaaaaaaacattaatacttgggacatttttattttgccaaggttctgggagaaggaaaagtgaagggttgggcaccatttagctcctggaattctgcaagtccttccgcctcctgcgttttggctgttgggcctttccccccactaattaaaagttttgctggggcgttgtcataaattaaatactttaatgaacgtgtaaccgaagcccatactctgcagccagtcctcctgggactctaccagctccctcaagttgggaaggcgttcctgcttgcctggtgccggtctaataagtggcccgcaaagcatgtgatattttgctttcgatttacaaaacaccagataaatggttattaataaggagatacccagctctctgtatttgtaacaaacgttaactggaattaccaagctctgttttcctaaagactgtaacttgactgggttttggcttaaagaatcaagaattcttttatgaagttcattttccaaggggccacctctgacctgttttttttgtccttccatattcttcaaatttggaggttttccttaaaagagagagaacagtgaccttagccccagggataaagaccagcaggggtaaatgttcccagaaacctccaaaaaccatagaaaagaaaggccatgttcccttgggtttcctgcagagacactgggataaatctgttctcaggatttaagcagtcattctgccaggccagggcctcattttcggtgagtggagtgatatatttattcattagcaagtgttgacattaggtagcaaaatgtgtgtaaacagagaagccacaaagacaggaatgtgccatttccaagggggagaaaagttctccagatcagccaataggaagtgattaacctgccaatcggaaactaagacagctggttactcacccaaaacgttttgttgaaaatagaacaaaaaaagaaatgagaaaaggcgctgctgtgtaagaatttagcatcagtaatagacaaagcccccacgaagggaattgtcctgccacattggaggacagccaggtctggagctggagcacaccccccccgcccccctcacaggtctggggctggttttgccagctgctgtggccgggggcattgaggtcagaccacagatgggcgctgacccaggtcttcatccccattttgcgtatgggagaatgtttggcccgggaatctacatggaccatttacattcttcagtttctatgtcccttaggttgaatttttggtcttgggttactagatgaaacaggcacaaagttttacagtggacaactgttaaaatcttaaccagttgcacaactaaaggaatacatcctgtgaagtctccatcttaggaaaaggtggtgggaatggggctggggcctggtaccctgcagcctttggagacacagagggctcaaagctaggaactccattttgctataatttaagccactccactcagcatctgggaggcctggactttagacacctaggtactgtgtggtccaaccaggagagccttctttgaaagagtgttcacatgactgaacctaggggaggccagttgtgacttgtggctgtcagaagtcagaaagacacccccacctccacatcccacaagaagtcagaatttgctgtttaaagctggatctcggggatagctgtgtgggctctgcttcccgtgtttcattgtatctgatggtctgaaaggtttgaggaatggctggccttggggggttgctgggtgagctcttgagggacccaggtggccagtatccatgggcagatccagcctgcaaatccagatcggaagtctggtgtcttgacctgagatctggcactgcgtttctctcttaaccgaggtccctcttaacttttctaggcctcttttaaaatcagcatgatgaaagagattaggtcattcattcatttattcattcattggttcagtcattcattttacaggcatgatgatgtgcctacctagaaatttgaggattccgatgcagtgctgtgttctttttttttccgagacagtctcattctgtgcccaggctggagtgcagtggcccgatctcggctcactgcaagctccacctcctgggttcacaccattgtcctgcctcagcctcccgagcagctgggactacaggtgcccgtcaccatgcccagctaattttttgtatttttagtagagacggggtttcaccgagttagccaggatggtctcgatctcctgacctcgtgtgatctgcccacctctgcttcccaaagtgctgggattacaggcgtgagccactgcacctggcagtgctgtgttcttttataaccagggttcatttgagttctgggttggttgaactacctggggcagagctgggacccttggggtacagtggtgagtaggggctcctctgtctttaacagtacttaggaagctcagaacgcagttgctgagactatcgtgggactcccagctcctttaccttgtactcattctcaatagttcgctccttggctgctccccagggttgggttttcaaagactctgttggagctgctcggagaaaggaatgagtctttttctctcgcagaacctagtgcttaccaagtgcttgataacacttagtgttgcgtgagtcaggagtggcctagagcttctgtctgccagccagcctgggctctggggaacaggcgacacaggcctaaggtgagaccctgacttcagagatctgtctatgcggagcttttctgtgggtgagagatggaggtatggctcctttaaccttgaggccagtctggatggcctggccacctccaggaaagagggtagggactccatagcctgcctggggagtgagagccatgggatagggctggactcttgggaatagcccagctcactgggtggccctttgagctagtcagtgacgcctcagtttacctggctgcctatggaacaggtatactttgcttcttcacaggggtggtagggaggcttaattaacgtttgtaaatccctcttgagatcaaagccactgcagaagggcagagcaccatttcacaaaaatgcttgtggttgcctgtgtggagctggcttacctttgatctgagatgggctgacaccctgaatgtggtctcagctctgctctgagatgcccggcttttcctttgaaacacaccttgcccctgggattctgccagccaaaggtggcggggagtggctgtggataagtcattatgtttaatgtgggggtgtcttccatctgggaggagtgggtggaggagagggttgagaagcctatctctagaaaatgatgaaggccatcaaaatggtttagaaagtgcagggtatacaccatttaacaagtaactccatttcctgcctgcctctattgttttctgtttgattaagtgtatcctgtaaaactgtatattcctgttaggaattagactttaccctgataaaatgagattacacacacagtcttctttccccctacccaccgcagccacctcacccccacgcctgcctccacttctgcccctcgcccgcttaggagagttcttgaaaagttgtccttccagccttgagaatgtgggagagggagtgaccctgagttagagagagaaacttagcattaagagggcagacagcagaaacccagagatggtttggggctatgtgtaggccactaaaggattcccatgggctacttgcccgtctgctctttttttttggctttcctatttgccagcatggccaagtggttccaactggaaacccacagggacattgtcctggtggcctggggtaggaggcctggtgtctgcacgatccaacctgttgtgtttgctgcggacctgggcagcacctttccttagccgggctctccgctaggacttcagggagtttggcgctgccagtggtgcatgacaagcttacagggtcttgtgtatttgtgtttcatgggactaatgagttgtggttcatggacattaggttttgctttaattgcttggagggcggttgtggagactgtttctcagctggaattgtcattatcctcattaacggtgaggtcactgtgcagagtacctgagggtgacagaagttgaagagaagtctagttaagggcagatgcaatctaaaggtaaaaatcagtgaggaaactccgagtgttgggtgccaaatgttttataggaactgagggcagagagccttagcaggtctggggttgcctgggaaggtttccagagatgaggggtttggactagcctgggagaggtagaacatttcccctccggctcggagccttgctgagaatgttctctgtcttgatctggtggtggttacacagatgtatacatgagtaacattcattgcgtctacttgggattttgtatactttgctctacttaagttagtcctcaattaaaaaaggggaaagaagtcccggcagcccaacatcaatcttgagaatgttttcaagaactgggaaacctgtctttaaaaggatgaaggcagagaggacatgggctccaaggagagagccttctgcccttgatgagggatgacagagcaaccagggttgagaaagtccaacccaaacctcctttgaccttgggaaccacctggtatccgtaatgggggactggtaatgcaagagaaattccagccagtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcaggtaagatgctttctcttattttcctggcaattccaaccttttttgaaattgctaaagactggaggaatgggggtggccttctgccaccccagctggtctggacttcattctcatttttatatgccttaagttggatgcatcggtggtgacattgtggtgcccttcagctcctcatcctgcagtcctttacgctctggacactggatccgttccgtggacggggagacaagagcgagctggggattgctttggtgtgtgaagtgttgcccggttatttttaagcagctcctggcttggggggcttcagcttggtgactttggtgtcattaactcatgcatttgagctctttttttgcttttgctctttgcgcatgggggatgtaaagggaatggacccacctttagggaacttgttgaagacagatcccaagcatacgatgggatttcagagtagatctgaggcttccctcccaagttctgattcccagcccagcctgctgcaggattttgcagcacatgtctggggctgggagcaccagggtgggagcactgccaacagtaggagctgtaattgttccctagcggggcaggttttcctcagggctcacaggtatgcgtgaaggcctggaatgccagtgctggggggtcacggggctggctgacaggcacggggtagccagagcattgttgttcctgaggatgcgaaaagagggcagtacttagagaaactcactggttatgtacatgggacgcatttcatgttgttctgaagaaatcctatttctacctgtttttccatccccaccatgtcatcactagattttctaagaactggctgaagcaagagggaaaacgaccttaaaaacagaaattccagcagagttttgggcatttggcatttccttgcctgtaggatcacgtggtagcagctcgaatagaagctgtgccctgttgtggtgtatcctcttgtgtgaggggcacccttttttgtggggtacctgctctgactacttggtggtgtgtcttccatggctggctcaggcaaagttcattcccggacggctccctccccggctctcctcttcaggaactgagcttgctgagaacgtctttagggagacccttgtttgttttcatttcaatgcaatatatactctgttatctgagactgagggtattgtttactcaaagcttctaatgagaattgagcaggaaaaagagggacctagagaagggagggggcttcaggcagtacggtgggagtggacagaggagttgaggagggagaaaaggcagcagtgtgtgaactgcatcttttctgctttctaaggctgagagagttcttgaaagaaagaaggccaatgagaggaaagggtctcagcagaataacacgctcaggatgttgttagatggttttattttttaaaccctgaatgtgcagggaggagccccggcccctccaaaccacatgaaataagcaagggaagtggcagcttttgaaagggtcctttcggaaggtttgtcttcttgataacatcttgtctgtctcccctgccggaggaaatgacgacaccaggctgagataccagcctgagtgcctcctcacccgcccgtgccatgtgacctgtgaagccctcaggagatgggtgggcttttttttttttttcttttttgacaaagtctcgctctgtcgcccaggctggagtgcagtggcgcgatttcggctcacacagacggagtctcgctctgtcaccaggctggagtgcagtggcccgatttcggctcactgcaacctccacctcccaggttcaagcaattctcctgcctcagcctcccaagtagctgggattacaggcatccaccactgtgcccagctaattttttgtatttttagtagagatggggtttcgccatgttggccaggctggtcttgaactcctgacctcggatgatccacccaccctttcctccccaagtgctgagattacaggtgtgagccactgcgcctggccgatgggtgggctttttttccccaaagctcttccagtcctagaaagaaactgggggtaaaacaatcattaactccttcccctcacccctccaggtaattgtagacacagatattaataaggagctgccaggaagaagcagtgactctctgaagggcagtgtggcttcagaagactgcagagagaagagggggccttccacatggcaagagcatttgttttgaatttcagctcttgatttactaattccaaaggcttcaaagtttgagctccttcttctttccgttcagagttggtgcagtgtattcataatgggccatggtggggagggtacactgttttgggggttgatgtcaccggcttgggggcgtctggaggggaggtgatgggcacggagaaaacctagggctgtcctctttgtagcgagaatgccttccaaaagggaactttattggcccctgtccagggcagagagttttgtaaatggagaaagcccaaacctcctccttttcaagaagttgatcgttccatggggggtggcctgggtgtgtctgccttgctgtggatgaggccagtgactggatgtggcagggctggatgggggaaggggcatagcagacactgaggttggggggtgggagcctggcagcaaggtggggagcagtgaaaactgaggagtttctccctcctcctccttgaaataacctctctgagcctctttcacaggccctgtgtgctgttttccttcctgtcctgccctggctgagagcgggcttaatgaatggggctcagtttagggtgggaggaaggtcggcagcaggagccagggcttgattctcttggcaagggaagaagggaaagaaaaaacagccgaatgtgaaaatgtggtgcctcggaggtgggggtggggtgtgctcaaaggccggtcctctcctgaaatgcaggggtgactccaaggctggcccttccctttcctgcgcccttgcaaactgcccgggaggaaggggagtgggcgggtaggagcccgggggcggggctgctggctgcaggttggaattccagcattgcagctttgttttgggggggtgtgggggggtgggtagacgacaggcctggtcgttagggacttgcagtgaaacacaccccacccttgcaagtttcctcggtctgggaaaatgggacatttttagaaggcagtgacttgcttccaggagattgtactttcatttttgacagctggctctctgagacagatggattgctgggtgcaagcttgtgtgtgtatgcgtgtgtgtgtgttgtgggggtgggtgtgtgggtgggtgggttttgccgcagacgtacagatagacaatcccgtgcgcaaacacatgagagcgtgcggatgcccacaggcaggctctgggatagggtgggtccctgtcgctggggtgggttgatgtcagggcggcctctccaagaggttgtggacttgtggggtggagtttgtggattgattctgctttgtgatttggcagtctgtgcctgactctctgggatgggtgtcttttgaaaggcatgcaactccagaacaggtccttgctgctgcttggacatggatgtgtcatggctcaggaagatcacctgggagaggtctgatgtagctgggaagcctctaggctcagctccgtcgtggagatggaaaggatttgctcccagagctttccggggatcactgggaatgcagagcatgtgttggaagctatcatctttgcagcctccatctggagtttctgtctgggggctttcattttgcctgtctgctgtcctggtttgagtgggttgagggagcagcatctcccttgtgagttgtaggttattcagctgcagactcatcttctagcctcctcctttatatatgaatgtctggagctggctgggcctcagccatatggacctgcccagttagggtagggattggaagccagcaaccacttgtagttatttaaacttcaaaagaagtgctcccatggatctcaaggagggaggtaggaggcagtggagacagaagtgctcacgtgtcctgggaaactccatctcttggctgtgcgaagtcatgcttgttggagagacccggcaccatgcctccaacccaagggtggccaactctttgcttgagattcatatgtggctactagtccccaagtctgggggatgggagcgtccttgagtcagtatccattcagcatccaaggatgtttctgtctccttctctttgatccttgctggcatctgtcatagtctcagaggagagccttcaaaaatacctatataatctgaaaatgcacccctggctcagtccacagttgacttgggctcaaaccaagtagcttaggaaacattgctccatcctgttttaaggaaagttaatcagctgcacgtgaacaattattcattgtctggcttggaattgtgatcatgaactgggaacctgggcctgggcgcctgttgctctgcttttaaattaagtcacctccccctgcctggctacaaaacagctcatggtttcactgaggtctctaatgccattgtggagtgagggcagggggcacaggttgagctcacaggcatgtgggcctttcatccaaatgctcatgagcgtggactttgggggactcaggtggacaggtgcttgtgaccatgagcaagctccttccttcccatccccttagtaccctgcaggccactgtgagaaatgacggcctagaactcaggggacaccttctgcctctccttaaacacctgccaacaggatgagtcagggctggggcgggctcacctggtgcacacccacaccctggtgaagaccagtcctggaccccgcctcttctgcagtgccccaggtcatgcacttccccctggagaagggcttactgataaaaccccttttgtcctggaaagaatgaggcagtccggcaggggttaaatacagggtgacagcatttaaaatctctggagcaaatttgggctgctctgccggccagacaagatggtctgctgccgcctcacgcatcctgtccccaggctgaactgggccagcaaagggagagggccaggtgaaggccaggctttgggtggtgtcacttttggtgacactgtagcatgctgattgcccctcacttcctacacacacacacacacacacacacacacacacacacacacacatgcctttacttagcaaagcctgactgtagctgcgtagacttgtacacctatgggacctccgtggcaagctcagagccggtggagcagtgaaaagggaggaaatgccgaagaattcatgatcaagtttggcttcctttgcttctttttaaaattttttaatgttttaattttttttttttttaattcgagatggagttttgctctgtcgcccaggctggagtgcaatggcaggatctcgagtcactgcaacctctgcctcctggattcaagggactctcctgcctcagcctctgagtagttggattgcaggcgtgcaccaccacgcccggctaatttgtgtacttttttgtagagagagggttttgccatgttggtcaggctggtcttgaactcctgacctcaggtgatccgcccgccttggcctcccaaagtgctgggattccaggcatgagccactgcgcccggcctctttgctcctttattattgttgttactgtgtcataattccttgcagaattatgatggccaggctggtctttacttccttcggtccaggccttgaactcggagcagcactctcaaagcagttgtcttcacctggcagaagaaaaaaaaggtgtaaagtgctggttcctggacttgctcgcacactaaaatccctcgggattcagcttcccagataactttcttgcttctttgtagagacatttgagagaaaactattattaactatacatggtccactgttttgctttgctgtcatgaatgggattgtaaaagggacccatgggaccgggtttccttttgggacgatgaaaatgttctggaactgtagagtggtgatggttgcacagttcaccgaatgtattcaatgccattggtggcacattttaagttatgtgtattttaccacaagtttgaccaaaaaatggccagcggtaggttttaaatacatgtagatacttggataatctataaggaacagtgattgtggagagtaaaattggagagacttctgttagttgcctaggacctgatgatggtagacacttgttttggtggcagccctgaggtcacatgggaagtacattgatggaccagggagcaaggctggtagcctgcctgggatctcgtgtgtgtgtgtgtggtgtgtgtgtgtgtgtgtgtgtgtgtgtgtgtgtgtgtgttttgagatggagtctcactctgtcaccctggctggagggcagtggcgtgatctcggctcactacaacctccacctcctgggttcaagccattctcatgcgtcagtatccctagcagctgggattacaggcgtgccacaccatgcctggctaatttttttctagtagaaagggcgtttcaccatgttggccagactggtctcgaactcctaacctcaagtgatcctcccgacttagcctcccaaagtgctgggattataggcgtgtaccaccacgcctggccttctgctgtgtgttacctgagcaagcagacacatctgtgctgatccttcgaccttccttttttcttcgtgggttccagaaatgagagacaggaaagttccctctggtttgattcccggcctgacttttctgctgggggaagtgaatatgcttgttctcactctgcggggtccccctggcctgcccatcccagtgactgcgaaccaggatggtgccagggttggctccaaaagctggtgatccagacccttcctgggcccctggagaccccagtccctgtgatgtccttgcccaagttctagggctgcagtggccgtaggtgactggcccgggcaccctccctttgcgggagcctcgtgaaaggatactgtaagcacagccacagggaggtcaccactggccctaccacctctcgctcggtattgaatggctagccccaagcctggctgcctgcctactgtcacacagaggcttcctctccgggctattttcagcgggaagatattattaactgctgaggcacagttctcaatttagtggttaacacaccaagaaagcaacactcacctgatcccggccactctacctaaacctgttggctcacttgggggactcggctgccccccagcctctctgtttctctctgtgggttcacctgggagatgtgggcttccactcccgtggaaggtgccccgtggattcagtatctgctagagagagaaccaggcttcttacgaagccaactcttaaaaggtgtagaaaatgatcgtatttatactctaagatggggacattttttgataggggtgggcactggctgggaaaagggactttcagcggtgttgaggacagttatttaaaacagggtgataactttcaccttgtaagttaacaggaaatattgggacaagacaggaaattgcatcatctttttttttgagaataactccagagaaaagtggttcgtgaaaggtagtggctgagaaacggctagcctgttttctgttttgtgttttttttttcttcccttccactcccacgagaacatgtaggccattttctttaagaaagaggctgtttgagaactttatgttatttttattatttaaaaaaatattttaccagaagggtcaccttcagttgaaatgttaactgccgccttatttcccattttactaaagaatctttcatgactttttcagcttccttccccaaatggtaaggccaagcagctcttggctggaagctaattttggtttggctggggagtcctcaacactgagccccacccagtgtcattagctcagttttaacttgcaaaaaaaagattgtatttttttttttgatggggggtacgtaagaatttactcacgcctttagcctttttacccacccccggtactgccttcccctaacagaggcacctggcacttagccgccgggaactcagggctgccttcgtgttttcaagccaccgtgtccccctcatcctgcaggagttctgtaactttcctgagactatttctagggtgctagtgaggagtggaggggaaatgggtctcggagctgccctggtacagctgtgtccagtaacggtgctgtgctttggaggaaggagtgatatggttcacctagaagcatctcccagagagggggcttatcacagccctacagtggtgcagataaggtccagttccattttttgtctctgggtttctaaatcccctctttgttgatgtcattgttctaatgacacagggcatgggacagtgccccggcccgtgctgccaaggagccgtctttaggacagagaccagaaagaaagagacctgtgtgtgtggctggcccgctctccactcacgctcacccccaccctcccagctttttccttagcgtgctttgttttgttttcataacacaacaagggccctggggtgtgtaaaagcattgttgaacacttggtgagggcaacttgtccaaacagagcaggacgccaaagcagaatgctgtgggcaggtggtgtgcccacagaggttggtgggccggcgccggccttggaaacacctctcagtggcatatgccgcggcggctgagtgtgacctagcgcagaacagggcttccctcttgtgtcctccgtggggagtccaggagagggacttggtccttctggctgactccgtgcttggaaggtgtgctcccctctcaggtgggttcacatgtgcctccctctgccgggtgtgaagctaggtgggcccgctgctttggaagaagccagtgtgtccctgtggtttgtttatggagcaaatatgtattgacacctattatgtgccaggctgtgtgctgtgcagaggaccagttcctgggctgggttagaattaagaattggcagttggaatggcttgtccgaaggtgatgttgaatccatggggatggagccggcgggaggggggattgactaggagttgcctctacctggaggcaggcaggggcagcttctgtaggacagaggagcctggtccctccatgaagccaggccataggtgggggaggtgcagggtgggccccctgggatgggcctagctcttgagtcatccacttctacttctgctttggttgtgtggtctgttgagaattgagataaagcaaagcttgtggataaacagaggtaggtctcccgggttttggttccagcccgcctccccaccccgcttcttgctgattgtaagatgacagcaggaagaacaggagctgtggttataatccaccctccagaccctggtagtacctggggcacagcacagagtggaagtgaccagcctagcgccaggctcctcagtggaccacggccaaggggtggggaaacatctggaaagacagtatctaatgtcttgacagccagaggagaagtgggatgttttcaaagcccaggagtgactttccctttgtaactccagaggacttgattcgcaacgaagaccatctgggggatgaaggaaattcttgctttttaattttaaatctgagggttaagcccgtttctgaggtgtcagccctgtgtgtgaggccctggcctgtctggggttgggtttggatgaaataatctaagatgcagttaccagggtgtttccttttcacattcatccttctctgtctgttcccccggggccaaccgatggcttccaagctctgtggagttcactaattgaattactcttctcgctcctccgtgaagccccaccaggaagaaaaggcggggagagctgcttttgctggggggtttgatcagagcagaaagggaagatctggtctcaattccaatttcatcttgcaaagtcgggactttctttcagccagaagacaactcagataaccaggccagcgactgtgtgctcatttcagtattgctttcttacgttttgatctgcgactgtcactcaacaggaacaaaaacaataagacgccaagatatgactgtgccgttggcagattagctgtctgcattttctggggtggctcactcggaggttaaatgattgtccctgtcccctgtcccaccttccagtcacctcatgaagctgttaagtgtctccttcccctgcaggctaagtgaggatcatcaagagctgggcctggggaccttgtcagcctcactgcagcctctgagccagccctgccccaccccctcatgaatcagtaaccaagagggaaaattaaaaagttagttatcagtgtgatctgagtgcaccataccgttcttacaaatagatgggccccatctcctgctcagtgggggcacaatcaaaaccctgctgggggggctgttttctggggaagagcccaggatcgtggggcctgcaaaaactcagaagcccccccaccttccccccagggtgtccaggatgccctagtcccaggagggggctgggagagaattacaatgtcggggccagcatcctccactttcctgtcactagaggctggcctgctctcctgggttgaggccgagtgtctcagcccctggctggccacatggccttgcaggagccatttctgtgttctgggcctcagttttctcatctgcaaaataagggcttgggcttggctgccaagtcccttcggtgatctgtgatctttgtctcttggatttgaggggtgtgggaatgatccccctattgatgagatatccctatggaagccaaagactgcttccattttaaaataaaaaggttgtagttctttctgtctcttggctcgcaaactcttccaagtatgggtgaaagctgaggactctgttcagaaaaatgcatgctataccacaatttgtatacatctgcagggggccgatatctttgctgaagcccagtcccacccgtggaatccccagttcaggaaatctatgcttatgaggactagttatgggggtgcaaaggagagccttaagagagctgaggcctttttcttttattgtggtaaaatatacataaaatataccatattaacaatttttaagtgtatagttctgtggcattaagtacattcatattgtgctattatccccaccgtccacatccagaactttttcatcttccctagctgaaactttgttcccatgaaacactaacttcccttctcccctcccccagcacttggcacccaccattctttctgtctatgaatttgcctcctcctctaggtacttcatagaatagtggaatcagacagtgtttgtccttttgtgatcggcttatttcacttaacataatgccctcagggttcatccatactctagcgtatgtcagaatttccttcttttttaaggctgaataatattttattgtatgaatattccatgtctggttgatttattgcttgatggacacttggcttgcttctaccttttggctattgtgaataatgctgctgtgaacatggatgtgcaaataccactggagtcgccgctttcagttcttctgggtatatacccagaggtggaattgctaaattacactgtcattctgtgtttaattttttaaggcatcgccaacggtagggcctccttgacttgtgcctcatgtgtcggcacacaccgatcgcatgcggtgggggagccctacccaccggggtgggcttgagggcgaatcctggggcagagggagtgagaaagcggggaggggacagtctgtccctgcgcggtgggggaggggcagtgctgggctgctgcagtcaccagccagattggagctcacatttatgggagcccatgtttatgggaggcctggaggctctgaaaggtggggcacccagcacagagcagctggccgtgtatgttggactccagggccttgtgacagcagcttctgggtgggggaccctttcattcttcttttattcccttgacctcctaactggaggttaggagtgggaggacccgccagagggagtgggggcttgggtctgggaggtcctgggtgctttaggggtgaaagggctgggatggctgaacagtgagtgtgtccaagcgggagagattagattacggaggcagacagaagtaatgattaacttttccagtctgcacgctgtctccaggctgtcgtactgttgtttttccctctaagtacagtgcggccctggcctggccaggccctggtattgggttgtaaagtgagagatggaatgagggctgggagtgcacggggaggggggccagggagggagctcgcaggagaagaaggagcttttccatcggatcctgcattggaatttattggccggaatgcagtaaatgttcaaaatgccatcccatccaacagttttcataattgttatggaacaaggggagccgggggaggggaggaatgaaaaggacttttgtttctcactgtatttttccatgtcttcggacagttttcctaccctctagaaactggagtggagttggatctgtgggggatagggtgggagaagggtctgcctttgggtcctgtgatgccttccaaggactaggggtcctggtagcctggggctttattaaaacgaggcccacagcaaaagtagcttggtttcttgcacacacagagcccccccaccacctgcaaaaccagggaaaaactgtcctgtccttctaggggttttgtccttttggaaaattggcttaatgatgcagtggtttgtattaagattttcatgatgctttaacgtgtgtgtgtgtgtgtgtgtgtgtgagtgagagagagagagagagagaaagagagaaagagattgagagagagagagagagaatgaatcagcattcagtgccagctgcccagttgggaatccagatagggaatttggggaatctcctacactctcagggtggcaggtgggtaggtgggtgaggtaagagacttgacttggtagtttctcttggacacgacagactttctgttccatgcttgtcccagcccttgtgtcttcctgggggtgccagggtcatgcccagagggaaggcagctgagcagacaatgccatgcagggctgagggcttctgtgcctgctaatatgtgaaccccctttctgaagagagctgctctgagttacttggggggtaacagtgggaacctggttggtgtaccatggaggggaagtatctggaaatttgaactcgagaaatgattcgactgcatgcacactaaacagcagccagagaggccctttactgtcaatattatgaatggagttggctgggtcgggagtccccacccttcctctgaggcctctctcagaggagcctgggcagagtgggcctcctcagacagcagtggctgcaggcagctgggtacacgctgtaatttgcatggctgaatgctggggcacaggaagccgcgtcagcctgactggcgagacagacaagagcttttgatttgtgtggctttcctcccctgccccgtgccaccctcaattacattctccatggcgagataaatgctcttaggagcattcatccccaggttgggggcttcagactcagatgcttggggggttttgggaggtggtgtgggaccagtttggggagccagggagtacattttagttctaggaattgattatttaacataatttgtaaggacacagtcactaattagtgttctagaccagcaggatctgcgaaatatgtaggcttgggagaggtggcaaggagggcggtgatgggaggagaaacttcagggaaccaagcctgggcagacagtggacggatgacagtgataaaagagatcctctcttgggggctcaccgtctcttgagggtgatgaatagtaagacagagtaaaaagtcatttctgactctgaaattaaagaaaaaaaaaagttggtttagagatggacacagcaaaacctgactcaaacctcctttcccttttgattttattttgttttattgttgcaaattaaatgcaaaaatgtaccctgctcctcaaagtggttttcttactctctggaaggtagtaaaaataaatggaaccagtgttgtttaatactgagaatcagagtccagccagagaccatgaaggcagaagggggcccatggggccatcttcccttgtcccctttacattatttatggacaggtcaaactgagaccctgagagggcaagccacttggccaaggtcacagagcagcttgctggcaaaaaagccgtatcaccccccacttcttgctgcaggggagttgcaccccatgcgcagctctaaaagctggtgcagcatttccaaagtgtgttctgaaggacactttggagaggaacagtgggcttggtggctttagaggcctgtgtccacagctcacaccaggcaatattctgggcttgaattgcagctctgcacttcggccagtgacttgtgcctcacccctactactccctttttttaagataggctggtgatagtatgcagcctcagagggttgtcatgagccacttagagaacacagcctatgcaaagtaaatgcttattaagtgtaggcattggcccagaactgttctaccatggggtgtggggatgtggagacaatcaggaagactggtgggcattttctgagcggctggagaacccaggagcctcagagatgagaccaacgtgtgtgcagcactctccacaagctggccccaatcacttttgcatcaaattggtacagcaaccttatgaggctggccttgggggaaccctgttttagggatgagctgaacttaccgggaggctgcatgcgaggttggtgtgaaatgcatatctggctttgtagctggtcggctcacctctggggttggcacaggggcgggggttctgccatggctagaatgcgctaaggggtggaaacgaagcctgctgggcccgggaaccagagagcagcctggcctttgaaggagaccctgtggcaccccctgcccacccccaagtccagccatctcacttcactggagatgctgcaaagcatgaaaaaaaaaaaatccagtgttctcaggtcagccttccaccagccaggattcatcgtctgatctgtttggggagagagcatggggtggtggagatgggttgggccccagtgttttctgattaactcgcagtttacctgaaacattttggtttgtttcctccatgaggaactcactctaaaccccagcattgtctgtgtttcctgaggagtctgagggagctctggggtcctatttcctcttttggatgaggctgtgagcatggtggattagagacagccccttaaagttagcccagatatctcagcaagttttacgcgtctctatttgggggagggattcgcctattgaaaacaagagaccagcaagggtccttgtgaattatgatggtttggcgtgagaatagatgggatggattggcactggagtccccttttatcttaggcttgtccctgaagagggcttgttgatatcagaacagccaatttcctgacagggttgggagcaggggatgggtgctgttaacctttgagatgtccgttgtggagggagagacaggatgaggcaaccgttggtggcgcctgggtcctgaggagggaggaccctggacctggcgttagcgaggcgtggtgatgtttgcgctcccaggttgccaggtgcaagctgtctgtgtccacatttctgcccttcatttgcccctgattggcacagggagcctgcaggaggcggccgtgcctgcccaggcgcccttcctccccaacttctccgtcctcagccttctgctctgctggaccatggaggagggggctgataggcccgtggccctgttggactttggcagaggaatatcacttcattatccaagtgcctcacagagatgagagccggtggagacccgtcctcactcgcctttgaccccagctcccggtaccctagcaattgggcacatttaaccgtgggtcatcagctgatggagctcatgtctttactggcttttttccccaagcttgcccttgttcctaaatggaatcttgggggaccccctccccacaagtacgttctttgtgtgtctgggcccagtcaggcccagatagcttctcttccacgcgtgcccgtgttctcataaccccatggctgttcttggagctgctctgcctctctgccctctgccttcaggtggagaatggtattgttgaggcactgagcaaggcctttcccccctcctcccatttttcttctttctcatctcctgacgccttcaaattaaaaatttaagaaggggtctgggtgcggcggctcacgcctataatcccagcactttgggaggctgaggctggcggatcacgaggtcaggagatcgagaccatcctggctaacacggtgaaaccctgtctctactaaaaatacaaaaaattagccaggcgtggtggcgggtgcctgtagtcccagctactcgggaggctgaggcaggagaatggcgtgaacccgggaggcggagcttgcagtgagccgagattgtgccactgcactccagcctgggcgacagagcgagactccatctcaaaaaaaaaaaagaaaaacatttaagaaggggaaaattccttgcttaacctaaaatgtggccttgaggcctggtcaccctgtgccattgagacctggggtgtgaggttcattcacgagcctctggtctcctggaagggtctggtctgttcattcatgagcagggtaattaaataactctttgtaagagtcagggagctccttgctaagtggtcttccccagttggagcgcaaacacaggctgaagtcctctcctttctcaacacccacctcccccttccctttaaagggaggattttatgctttaagggaaatggggaaggttgggggggggcaacaccttaaaggaattttaggcagattcagcatttttctggtgttgctccaaaaattccccacactgtaataaaaagatacaactgtgagcaggcatctgattagtgagctttttacaacacagcttttcttttggatgctttaaaatgaacacatactgttttaaaacaagcccctgtacagttttctggggagggggagaagtttgtggaaaataccggaaaaggttataaagctgagggaaattaacaaaggactgtgagttttgccttcagaggttaactatcagcgagaggccaaggctcttccttagtccttgtactgactgaacttcccagcccctcgacacgtggcccgggaagtccctgggagcaaagcgtccacacagacctttgtggggagactcgtgtgggctgtgggcccgattcagggaactgtgtttctgtgaagatgaagctgagcatttcccagaaatgagcccaaatggcggggaattcagggcaaaggggaatctctgtagtggcaatgggggatgtcgtgcggggtccccagaaggtgtgatgtccacacaagggtgtgtgttcgaggggcctttgctgttgccgaatggttttgctggaaagcttgttttttgtgtgtgcttagagatagtcccggcaggaggagactggagctgtcctaacgggaggacagaggctgctggtgggggagctggaggggacagcgagggaggagcaggcaggagtctccctgcggtgggttagggcaccaaatggacttcagggcccttgttcacacacagcagcattcacgacatccatgcattgcagtttttctgggctgggccattaacctcagcagaaaaatgctttttccagggggtgtctggcagcacattgctggcgggctgcacagatgaaacagaaacccacctgacacttccccgtcctgctacagatctcaggctccagtccccacccagcttcctctgcccccagaggcccccacccttggcagacaaggcttccaccccttgcctaggtggctgacaggcctggcatgggggcacctcgatctcaggtccatactccactcactcccttgctcctcctcctcctcctcctgttggccggtgccaggtttcagtgggtcctggctgcatgaaacaaagcattgtgaggctctgctgagggtctcccacccaccctccctcccgcctccttcccagcagctcctcgagtcttcctttccaggccaggtttgttgtcccgaattgggaaaataagcaaaagcttcttgtgtttcagaacaccctcctccacaccaaaagggtggatgtgctgtgcctcccggaagagggctttctcccccgcttcacacttgatgccaatgtgtccttccttccctgggcgttcaggtctttggtgtagccttcagagctgagttccctcagcaagaaagttcaaagattgccagcgctcacaagtttattagcagttgatggatactttgcagaaacaagtgaatgcctgatgagtcaccttctccctgtccctgtcttgttttccatatgttccagtacgtatgtgcacacagaaacacacataacacacactcgtacacactgacatcatggacacagtcttgcacacgcacatgcacaagcactggacttccaagctacatggggggtggtgaccggccagttttctggtgttgatttttagtgggggttgggggttgagggaaaggaatgagacctcagtgtcccctttttgtggagcttttggggcaggcatttgggaaggccagcttggggtgtctgtagggaaccgctgctctgggtgtgtgtgtctgtggctgccccagcaggccgcagtgtgcacatttgtatggccttactgacgggcacctccatccaacactggctgctacttaaaacaacaacaacaacaacaacaactgagtggagccagtgggttcccaggtcctaacacgcctgtaaaagttggagccagttagtgtcctgggctgccccagttacccagcctgctggggcagcaggatgcggccccatcttccgccatggaccccctgcagggtgcaacccatcatcattgactctgaacccagttactccagaaacacaaaggccacaccaaaacacatctcacactcaacccctgctttgtgccccccaggtccccaagaggaggagctggggctgcagggagcgagggcaaggccctgaccgacgtggggcccttcccctctgcttttccccctctgctgtccccatttttgttaacaaatacaagacttccggtctccaccctgctgccacaaaccacagcgttcctgcagtctggctgggctggggagatttatggtcccaagtctgaggcctgcccgctggctcctacttaaggaggagtcagaatgcccgccgccggggctccctttccctccgtgtgaccccccttttaaagtcctccaagtgcctgttgaggaaaattaccttaccagaatcaccccggcccccaggctgcctgtgggaagactgtgtagggaagcggggcggggcctgcaggggagggatgagggcggagcagggcgccctgcaggctccagatgcttctgtggaaggaggggagagagggggcacccctggggatgggggtgccggcagagaaggggagaagggggacgcatctatttgagacacataatcttctgtctgggctggaggaagctttgttaaggtagcccgggttaataccggtctgcatgttgtgatttggcattttgacatgaattcaccctttgtgtacagggctgctgctgacacactgagactgttttcctattaggaatatagatgtttttgtcccaagccaccctcatttttatttttaccagataggttcctcatgaccacggcactgatttgagagctgggtgacaggcacccagagaccatcgcataggtggtcccagagtctagacacctgggttctagctctggctgtgtcatcccctggtactccagcagcaggctttctgggtcctggttttctcatcaggatgacaaggggctggaggagctggccttcaaggttccatccagttgaaagatctgtaactccaggacgttgctgaggctttttgaggccctaaaagcagactacccaagctattaagggtccctttgcatctgtgctctgcagagaagaggctttgttggccaggtgggcacagatgctggtgtactggactcctgatgggcaggggcctggagagaagcagcacccagcgcttcctatgcttaaagaaaggcagggtcctggtcaaagggctgtaagagcctgggcaagtccaggactagcctcaccgcctccttctttctgtctcgtcctgagagatgagctggtgactgggtgcagtgggggggcgggtgtcttcattctaggagtcaccaatgcctgtccccactaaccctctctgccaatgtgttttctagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgatttcatgttgtcctccaactcctttttcttctgctgcttggagggagtggggaggagtgagtattcatccaaattcagttgagttggcgtcttcccagcccagtgcttggaggatgggagacgtgggccacaaaagagacatctagaacagccctggtcttcaagagtgctggaaagacctgcagccacccagacatccctccttcttgtgtcttgaatttgtaatgggagacaacctacaggagctctgtgggtgataattcaaagcttgtagaattgaggacagggaattacatctagggtaatgggaaggagacaggattagaggatggatggatggagaagtttagccccaagaacctgggtccatctggttcttgccaactcctcacttggtattaaatcctaagcctactgtacccctgctagactggattccaggagaagtttcctgggggctgagaccctggaagggtgatgaaggtgggggttgaatgtcagtggtgttcagagggactaggccacctcctggcgccctcccaaatactgtcctgggccacagaagtcacagagtacaagttccactctgcaatatcgtcccttgtctgctgggacttaagtgacagttcactagtccccttccccagcctagctctggtggcacttgcagtcaaaatgcctcttcagtgctgtctttgcatcagcctgccttggttcgctgctgaaccgtgatctgagccatgttttagatttgggaaatcttgcacaagagatggtctaaattgggtaccaaacaaacggctgtgcaggtgtctatgtaaggggttttgaaccttatatccaggaagggggtccttttgaagtgggggttaagatttgaatatcataagcctgtacaatttcatgaaagctttttggaaggccaatgtaggacagccaactttctattttgccaaaaaatgaccaaaagcgctacagcctactggcgccaccacttcattaaagggaatgacagtacaattggttagcaagaaatattaatacatgttgattgctgatttatgctccagggcattaatgccaagtggtcatcctggccaacttgtttacatgtgatagggagcttactacctctaaaagtagcttttgcttttttttgttttttttgagatggaatctcgctttgtcgcccaggctagagtgcagtgatctcggctcactgcagcctctgcctcccgggttcaggcaattttgctgcctcagcctcctgagtaactgggattacaggaacacactaccacacccggctaattttttgtatttttaacagagatggggtttcatcacgttggccaggctggtcttgaactcctgaccttaggtgatccacccgcctcggcctttcccaaagtgttgggattacaggtgtgagccaccacgcctggtcgctttttgctttttatcattgaactgaaacttgcttacatcgtagttctgtaacccagaataagtgcaaaatctcatctctagaaaacacccaaggagggttctaattaactctagggtggtagcggcggaggaggggcagggagggaaggtgtttcactgggggctgtcaaagttattttagtttgctctaaattgcgt

SEQ ID NO: 3 - DNA, 2386 bp, Homo sapiens
agtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 4 - DNA, 2293 bp, Homo sapiens
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 5 - DNA, 3085 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 6 - DNA, 1281 bp, Homo sapiens
atgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaatgtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtag

SEQ ID NO: 7 - DNA, 3111 bp, Homo sapiens
ggcacgagcggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggtcagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgttttttcctatgggtgttatcacctagctgaatgtttttctaaaggagtttatgttccattaaacgatttttaaaatgtacacttgaaaaaaaaaaaaaaaaa

SEQ ID NO: 8 - DNA, 24 bp, Artificial sequence
  Primer
ccatcaaggcttttgactatgaga

SEQ ID NO: 9 - DNA, 20 bp, Artificial sequence
  Primer
ccatggttgctgcatgaact

SEQ ID NO: 10 - DNA, 21 bp, Artificial sequence
  Probe
ctacagcctgcagcggcccaa

SEQ ID NO: 11 - DNA, 24 bp, Artificial sequence
  Primer
tttctcaaaccaactgcagactgt

SEQ ID NO: 12 - DNA, 22 bp, Artificial sequence
  Primer
cagataattcgttccccctgtt

SEQ ID NO: 13 - DNA, 24 bp, Artificial sequence
  Probe
cagatgctgtgccttcctccgctg

SEQ ID NO: 14 - DNA, 20 bp, Artificial sequence
  Synthetic oligonucleotide
cggctgccccaccccgcgcg

SEQ ID NO: 15 - DNA, 20 bp, Artificial sequence
  Synthetic oligonucleotide
ggcaggagcggcggcggccc

SEQ ID NO: 16 - DNA, 20 bp, Artificial sequence
  Synthetic oligonucleotide
gcgaacatgacctccgcaca

SEQ ID NO: 17 - DNA, 20 bp, Artificial sequence
  Synthetic oligonucleotide
tcgccccttctccccgcagc

SEQ ID NO: 18 - DNA, 20 bp, Artificial sequence
  Synthetic oligonucleotide
gcccgggccgccgccaccgg

SEQ ID NO: 19 - DNA, 20 bp, Artificial sequence
  Synthetic oligonucleotide
tggcacctcgcaccgccttg

SEQ ID NO: 20 - DNA, 20 bp, Artificial sequence
  Synthetic oligonucleotide
gagcagcagctccagctgcc

SEQ ID NO: 21 - DNA, 20 bp, Artificial sequence
  Synthetic oligonucleotide
agcctcttgacttccgagga

SEQ ID NO: 22 - DNA, 20 bp, Artificial sequence
  Synthetic oligonucleotide
cagcctcttgacttccgagg

SEQ ID NO: 23 - DNA, 20 bp, Artificial sequence
  Synthetic oligonucleotide
tttgccccaaaactccaaag

SEQ ID NO: 24 - DNA, 20 bp, Artificial sequence
  Synthetic oligonucleotide
ttgttcctctgcaccctggg

SEQ ID NO: 25 - DNA, 20 bp, Artificial sequence
  Synthetic oligonucleotide
ggtatctggagtaaggaggg

SEQ ID NO: 26 - DNA, 20 bp, Artificial sequence
  Synthetic oligonucleotide
agtctccgagttatccccat

SEQ ID NO: 27 - DNA, 20 bp, Artificial sequence
  Synthetic oligonucleotide
ccaaggttacatacaacctg

SEQ ID NO: 28 - DNA, 20 bp, Artificial sequence
  Synthetic oligonucleotide
aaaactttgtgcctgtttca

SEQ ID NO: 29 - DNA, 20 bp, Artificial sequence
  Synthetic oligonucleotide
tttgaaaacccaaccctggg

SEQ ID NO: 30 - DNA, 20 bp, Artificial sequence
  Synthetic oligonucleotide
gtgtgtttcaaaggaaaagc

SEQ ID NO: 31 - DNA, 20 bp, Artificial sequence
  Synthetic oligonucleotide
aaacatttggcacccaacac

SEQ ID NO: 32 - DNA, 20 bp, Artificial sequence
  Synthetic oligonucleotide
agttaatcattactcgagtc

SEQ ID NO: 33 - DNA, 20 bp, Artificial sequence
  Synthetic oligonucleotide
tgctgattattaatggtctg

SEQ ID NO: 34 - DNA, 20 bp, Artificial sequence
  Synthetic oligonucleotide
agcatgaaagacaaaccaca

SEQ ID NO: 35 - DNA, 20 bp, Artificial sequence
  Synthetic oligonucleotide
aaataaaaacaccaagatcc

SEQ ID NO: 36 - DNA, 20 bp, Artificial sequence
  Synthetic oligonucleotide
ccccgtccacggaacggatc

SEQ ID NO: 37 - DNA, 20 bp, Artificial sequence
  Synthetic oligonucleotide
cagctcctactgttggcagt

SEQ ID NO: 38 - DNA, 20 bp, Artificial sequence
  Synthetic oligonucleotide
acacactgctgccttttctc

SEQ ID NO: 39 - DNA, 20 bp, Artificial sequence
  Synthetic oligonucleotide
aagaagaaggagctcaaact

SEQ ID NO: 40 - DNA, 20 bp, Artificial sequence
  Synthetic oligonucleotide
cgtctgcggcaaaacccacc

SEQ ID NO: 41 - DNA, 20 bp, Artificial sequence
  Synthetic oligonucleotide
atggatactgactcaaggac

SEQ ID NO: 42 - DNA, 20 bp, Artificial sequence
  Synthetic oligonucleotide
tgcctcattctttccaggac

SEQ ID NO: 43 - DNA, 20 bp, Artificial sequence
  Synthetic oligonucleotide
aatagttttctctcaaatgt

SEQ ID NO: 44 - DNA, 20 bp, Artificial sequence
  Synthetic oligonucleotide
aaggacatcacagggactgg

SEQ ID NO: 45 - DNA, 20 bp, Artificial sequence
  Synthetic oligonucleotide
agtaaaatgggaaataaggc

SEQ ID NO: 46 - DNA, 20 bp, Artificial sequence
  Synthetic oligonucleotide
cgccggcccaccaacctctg

SEQ ID NO: 47 - DNA, 20 bp, Artificial sequence
  Synthetic oligonucleotide
gctttgaaaacatcccactt

SEQ ID NO: 48 - DNA, 20 bp, Artificial sequence
  Synthetic oligonucleotide
ccagaaaatgcagacagcta

SEQ ID NO: 49 - DNA, 20 bp, Artificial sequence
  Synthetic oligonucleotide
actgggcttcagcaaagata

SEQ ID NO: 50 - DNA, 20 bp, Artificial sequence
  Synthetic oligonucleotide
ccccgtgcactcccagccct

SEQ ID NO: 51 - DNA, 20 bp, Artificial sequence
  Synthetic oligonucleotide
agctggcactgaatgctgat

SEQ ID NO: 52 - DNA, 20 bp, Artificial sequence
  Synthetic oligonucleotide
ctcccaagcctacatatttc

SEQ ID NO: 53 - DNA, 20 bp, Artificial sequence
  Synthetic oligonucleotide
cctgattgtctccacatccc

SEQ ID NO: 54 - DNA, 20 bp, Artificial sequence
  Synthetic oligonucleotide
aaaaaaaacgaccaaagagt

SEQ ID NO: 55 - DNA, 20 bp, Artificial sequence
  Synthetic oligonucleotide
aaagcactacaatgctaaat

SEQ ID NO: 56 - DNA, 20 bp, Artificial sequence
  Synthetic oligonucleotide
aaatattagcagcaaagtag

SEQ ID NO: 57 - DNA, 20 bp, Artificial sequence
  Synthetic oligonucleotide
aattggttctggttcggcca

SEQ ID NO: 58 - DNA, 20 bp, Artificial sequence
  Synthetic oligonucleotide
acgcggctaccggctgttga

SEQ ID NO: 59 - DNA, 20 bp, Artificial sequence
  Synthetic oligonucleotide
agaaaaatagcttatgttaa

SEQ ID NO: 60 - DNA, 20 bp, Artificial sequence
  Synthetic oligonucleotide
agctatttctcaaagagcga

SEQ ID NO: 61 - DNA, 20 bp, Artificial sequence
  Synthetic oligonucleotide
aggtactgcctctgccccac

SEQ ID NO: 62 - DNA, 20 bp, Artificial sequence
  Synthetic oligonucleotide
atgaaagaagagttaggtgt

SEQ ID NO: 63 - DNA, 20 bp, Artificial sequence
  Synthetic oligonucleotide
cacaccatccacctcccgcg

SEQ ID NO: 64 - DNA, 20 bp, Artificial sequence
  Synthetic oligonucleotide
cacaggatgggagcaggcag

SEQ ID NO: 65 - DNA, 20 bp, Artificial sequence
  Synthetic oligonucleotide
caccagctgactcttgttgt

SEQ ID NO: 66 - DNA, 20 bp, Artificial sequence
  Synthetic oligonucleotide
ccaggagggtatgcacactc

SEQ ID NO: 67 - DNA, 20 bp, Artificial sequence
  Synthetic oligonucleotide
cccagcccagaaaaactgca

SEQ ID NO: 68 - DNA, 20 bp, Artificial sequence
  Synthetic oligonucleotide
ccccagaaaactgtacaggg

SEQ ID NO: 69 - DNA, 20 bp, Artificial sequence
  Synthetic oligonucleotide
cgtccacggctgctgcataa

SEQ ID NO: 70 - DNA, 20 bp, Artificial sequence
  Synthetic oligonucleotide
cgtcttctcctcccagtatg

SEQ ID NO: 71 - DNA, 20 bp, Artificial sequence
  Synthetic oligonucleotide
cgtgtccttgatgagggaga

SEQ ID NO: 72 - DNA, 20 bp, Artificial sequence
  Synthetic oligonucleotide
ctcagggagatccaggagca

SEQ ID NO: 73 - DNA, 20 bp, Artificial sequence
  Synthetic oligonucleotide
ctgctcagctcacgctctgt

SEQ ID NO: 74 - DNA, 20 bp, Artificial sequence
  Synthetic oligonucleotide
ctgggcccagacacacaaag

SEQ ID NO: 75 - DNA, 20 bp, Artificial sequence
  Synthetic oligonucleotide
cttgctggcctaatagcaga

SEQ ID NO: 76 - DNA, 20 bp, Artificial sequence
  Synthetic oligonucleotide
ctttaataaatctcaggttt

SEQ ID NO: 77 - DNA, 20 bp, Artificial sequence
  Synthetic oligonucleotide
gaaaaacctgatgtcaccag

SEQ ID NO: 78 - DNA, 20 bp, Artificial sequence
  Synthetic oligonucleotide
gcatttgttatttgcattta

SEQ ID NO: 79 - DNA, 20 bp, Artificial sequence
  Synthetic oligonucleotide
gctaagaacagtgtcgaagt

SEQ ID NO: 80 - DNA, 20 bp, Artificial sequence
  Synthetic oligonucleotide
gctgctgatgaactggcggg

SEQ ID NO: 81 - DNA, 20 bp, Artificial sequence
  Synthetic oligonucleotide
ggttatgacggaccaaatcc

SEQ ID NO: 82 - DNA, 20 bp, Artificial sequence
  Synthetic oligonucleotide
gtgtcctgccgatcatacct

SEQ ID NO: 83 - DNA, 20 bp, Artificial sequence
  Synthetic oligonucleotide
gtttggtggtgcttggattt

SEQ ID NO: 84 - DNA, 20 bp, Artificial sequence
  Synthetic oligonucleotide
tcacacacactcctgacaag

SEQ ID NO: 85 - DNA, 20 bp, Artificial sequence
  Synthetic oligonucleotide
tctattctcacgccaaacca

SEQ ID NO: 86 - DNA, 20 bp, Artificial sequence
  Synthetic oligonucleotide
tgcacactctcccaggaggg

SEQ ID NO: 87 - DNA, 20 bp, Artificial sequence
  Synthetic oligonucleotide
tgcatgaaaagcaagcactc

SEQ ID NO: 88 - DNA, 20 bp, Artificial sequence
  Synthetic oligonucleotide
ttaacccgggctaccttaac

SEQ ID NO: 89 - DNA, 20 bp, Artificial sequence
  Synthetic oligonucleotide
ttccctacagacaccccaag

SEQ ID NO: 90 - DNA, 20 bp, Artificial sequence
  Synthetic oligonucleotide
ttgggactgcaaacctctct

SEQ ID NO: 91 - DNA, 20 bp, Artificial sequence
  Synthetic oligonucleotide
ctccggctgccccaccccgc

SEQ ID NO: 92 - DNA, 20 bp, Artificial sequence
  Synthetic oligonucleotide
cgacagcagcagcagcaggg

SEQ ID NO: 93 - DNA, 20 bp, Artificial sequence
  Synthetic oligonucleotide
gagcgaacatgacctccgca

SEQ ID NO: 94 - DNA, 20 bp, Artificial sequence
  Synthetic oligonucleotide
tcggctgtccgtcgcccctt

SEQ ID NO: 95 - DNA, 20 bp, Artificial sequence
  Synthetic oligonucleotide
atccagccctgcccgggccg

SEQ ID NO: 96 - DNA, 20 bp, Artificial sequence
  Synthetic oligonucleotide
cgcccgcggctggcgggtgg

SEQ ID NO: 97 - DNA, 20 bp, Artificial sequence
  Synthetic oligonucleotide
ccacggcctggagcagcagc

SEQ ID NO: 98 - DNA, 20 bp, Artificial sequence
  Synthetic oligonucleotide
cacagcctcttgacttccga

SEQ ID NO: 99 - DNA, 20 bp, Artificial sequence
  Synthetic oligonucleotide
tccaactctctttgccccaa

SEQ ID NO: 100 - DNA, 20 bp, Artificial sequence
  Synthetic oligonucleotide
tgaaccctcacatcacactc

SEQ ID NO: 101 - DNA, 20 bp, Artificial sequence
  Synthetic oligonucleotide
tcccatctatcgaatcaccc

SEQ ID NO: 102 - DNA, 20 bp, Artificial sequence
  Synthetic oligonucleotide
cttgagggagctggtagagt

SEQ ID NO: 103 - DNA, 20 bp, Artificial sequence
  Synthetic oligonucleotide
tgacagccacaagtcacaac

SEQ ID NO: 104 - DNA, 20 bp, Artificial sequence
  Synthetic oligonucleotide
ggtctcaccttaggcctgtg

SEQ ID NO: 105 - DNA, 20 bp, Artificial sequence
  Synthetic oligonucleotide
gaaatggagttacttgttaa

SEQ ID NO: 106 - DNA, 20 bp, Artificial sequence
  Synthetic oligonucleotide
tccccttttttaattgagga

SEQ ID NO: 107 - DNA, 20 bp, Artificial sequence
  Synthetic oligonucleotide
accttgtcacccgtctgggc

SEQ ID NO: 108 - DNA, 20 bp, Artificial sequence
  Synthetic oligonucleotide
cggccttgatgctgattatt

SEQ ID NO: 109 - DNA, 20 bp, Artificial sequence
  Synthetic oligonucleotide
acgctctaaacagcatgaaa

SEQ ID NO: 110 - DNA, 20 bp, Artificial sequence
  Synthetic oligonucleotide
tgctgtggatttgaaaaggg

SEQ ID NO: 111 - DNA, 20 bp, Artificial sequence
  Synthetic oligonucleotide
ccaagccaggagctgcttaa

SEQ ID NO: 112 - DNA, 20 bp, Artificial sequence
  Synthetic oligonucleotide
tcttttcgcatcctcaggaa

SEQ ID NO: 113 - DNA, 20 bp, Artificial sequence
  Synthetic oligonucleotide
aaaaaaagcccacccatcgg

SEQ ID NO: 114 - DNA, 20 bp, Artificial sequence
  Synthetic oligonucleotide
cccaaaacagtgtaccctcc

SEQ ID NO: 115 - DNA, 20 bp, Artificial sequence
  Synthetic oligonucleotide
gcacagactgccaaatcaca

SEQ ID NO: 116 - DNA, 20 bp, Artificial sequence
  Synthetic oligonucleotide
gattatataggtatttttga

SEQ ID NO: 117 - DNA, 20 bp, Artificial sequence
  Synthetic oligonucleotide
tcttgtctggccggcagagc

SEQ ID NO: 118 - DNA, 20 bp, Artificial sequence
  Synthetic oligonucleotide
gttccttatagattatccaa

SEQ ID NO: 119 - DNA, 20 bp, Artificial sequence
  Synthetic oligonucleotide
tgtgcctcagcagttaataa

SEQ ID NO: 120 - DNA, 20 bp, Artificial sequence
  Synthetic oligonucleotide
agtgttgaggactccccagc

SEQ ID NO: 121 - DNA, 20 bp, Artificial sequence
  Synthetic oligonucleotide
ttccaagcacggagtcagcc

SEQ ID NO: 122 - DNA, 20 bp, Artificial sequence
  Synthetic oligonucleotide
agcttggaagccatcggttg

SEQ ID NO: 123 - DNA, 20 bp, Artificial sequence
  Synthetic oligonucleotide
agaaaacagcccccccagca

SEQ ID NO: 124 - DNA, 20 bp, Artificial sequence
  Synthetic oligonucleotide
agccaagtgtccatcaagca

SEQ ID NO: 125 - DNA, 20 bp, Artificial sequence
  Synthetic oligonucleotide
tgcaggatccgatggaaaag

SEQ ID NO: 126 - DNA, 20 bp, Artificial sequence
  Synthetic oligonucleotide
caagtctcttacctcaccca

SEQ ID NO: 127 - DNA, 20 bp, Artificial sequence
  Synthetic oligonucleotide
gtcatccgtccactgtctgc

SEQ ID NO: 128 - DNA, 20 bp, Artificial sequence
  Synthetic oligonucleotide
aaaatgcccaccagtcttcc

SEQ ID NO: 129 - DNA, 20 bp, Artificial sequence
  Synthetic oligonucleotide
tcccaggagggtatgcacac

SEQ ID NO: 130 - DNA, 20 bp, Artificial sequence
  Synthetic oligonucleotide
ggtatgcacactctcccagg

SEQ ID NO: 131 - DNA, 20 bp, Artificial sequence
  Synthetic oligonucleotide
caggctccctgtgccaatca

SEQ ID NO: 132 - DNA, 20 bp, Artificial sequence
  Synthetic oligonucleotide
ccagaccccttcttaaattt

SEQ ID NO: 133 - DNA, 20 bp, Artificial sequence
  Synthetic oligonucleotide
ggcctctcgctgatagttaa

SEQ ID NO: 134 - DNA, 20 bp, Artificial sequence
  Synthetic oligonucleotide
atcgaggtgcccccatgcca

SEQ ID NO: 135 - DNA, 20 bp, Artificial sequence
  Synthetic oligonucleotide
tcaatgatgatgggttgcac

SEQ ID NO: 136 - DNA, 20 bp, Artificial sequence
  Synthetic oligonucleotide
agatctttcaactggatgga

SEQ ID NO: 137 - DNA, 20 bp, Artificial sequence
  Synthetic oligonucleotide
ctggacacagtagagcctcc

SEQ ID NO: 138 - DNA, 20 bp, Artificial sequence
  Synthetic oligonucleotide
gcaccttctgcaccagctga

SEQ ID NO: 139 - DNA, 20 bp, Artificial sequence
  Synthetic oligonucleotide
caccttgtgtaccaacagcg

SEQ ID NO: 140 - DNA, 20 bp, Artificial sequence
  Synthetic oligonucleotide
cggtaaagcccgtccacggc

SEQ ID NO: 141 - DNA, 20 bp, Artificial sequence
  Synthetic oligonucleotide
cagcacgggcagctgctgat

SEQ ID NO: 142 - DNA, 20 bp, Artificial sequence
  Synthetic oligonucleotide
cgctctgtcccctccgcacg

SEQ ID NO: 143 - DNA, 20 bp, Artificial sequence
  Synthetic oligonucleotide
ggcctgctcagctcacgctc

SEQ ID NO: 144 - DNA, 20 bp, Artificial sequence
  Synthetic oligonucleotide
ctcaggaggaaaatattagc

SEQ ID NO: 145 - DNA, 20 bp, Artificial sequence
  Synthetic oligonucleotide
tttgcatgaaaagcaagcac

SEQ ID NO: 146 - DNA, 20 bp, Artificial sequence
  Synthetic oligonucleotide
caaacgaggacgagaagaag

SEQ ID NO: 147 - DNA, 20 bp, Artificial sequence
  Synthetic oligonucleotide
tcttttcataagctatttct

SEQ ID NO: 148 - DNA, 20 bp, Artificial sequence
  Synthetic oligonucleotide
cctcttcctatcagggtgtc

SEQ ID NO: 149 - DNA, 20 bp, Artificial sequence
  Synthetic oligonucleotide
atgaccgccccccttcatac

SEQ ID NO: 150 - DNA, 20 bp, Artificial sequence
  Synthetic oligonucleotide
ctgccgctcctgcacacgcg

SEQ ID NO: 151 - DNA, 20 bp, Artificial sequence
  Synthetic oligonucleotide
gcttgggactgcaaacctct

SEQ ID NO: 152 - DNA, 20 bp, Artificial sequence
  Synthetic oligonucleotide
gggaccccagccgccagctt

SEQ ID NO: 153 - DNA, 20 bp, Artificial sequence
  Synthetic oligonucleotide
tggacaggcccgtgtccttg

SEQ ID NO: 154 - DNA, 20 bp, Artificial sequence
  Synthetic oligonucleotide
gaataagacaaggatgaaaa

SEQ ID NO: 155 - DNA, 20 bp, Artificial sequence
  Synthetic oligonucleotide
ggctgccccggcagcccttg

SEQ ID NO: 156 - DNA, 20 bp, Artificial sequence
  Synthetic oligonucleotide
ctaagtccgggaaaaacctg

SEQ ID NO: 157 - DNA, 20 bp, Artificial sequence
  Synthetic oligonucleotide
acacacaggatgggagcagg

SEQ ID NO: 158 - DNA, 20 bp, Artificial sequence
  Synthetic oligonucleotide
agcatgtccctcccagggac

SEQ ID NO: 159 - DNA, 20 bp, Artificial sequence
  Synthetic oligonucleotide
tggtaccttgggttatgacg

SEQ ID NO: 160 - DNA, 20 bp, Artificial sequence
  Synthetic oligonucleotide
gttgtagaagaaatgaaaga

SEQ ID NO: 161 - DNA, 20 bp, Artificial sequence
  Synthetic oligonucleotide
tgctcattgagctaagaaca

SEQ ID NO: 162 - DNA, 20 bp, Artificial sequence
  Synthetic oligonucleotide
aatgcttctcttgttcattt

SEQ ID NO: 163 - DNA, 20 bp, Artificial sequence
  Synthetic oligonucleotide
tttctctctcaaagcactac

SEQ ID NO: 164 - DNA, 20 bp, Artificial sequence
  Synthetic oligonucleotide
tttcttgtttatacacattg

SEQ ID NO: 165 - DNA, 20 bp, Artificial sequence
  Synthetic oligonucleotide
cttttttaatttggcatttg

SEQ ID NO: 166 - DNA, 20 bp, Artificial sequence
  Synthetic oligonucleotide
tccggctgccccaccccgcg

SEQ ID NO: 167 - DNA, 20 bp, Artificial sequence
  Synthetic oligonucleotide
gctccggctgccccaccccg

SEQ ID NO: 168 - DNA, 20 bp, Artificial sequence
  Synthetic oligonucleotide
cgctccggctgccccacccc

SEQ ID NO: 169 - DNA, 20 bp, Artificial sequence
  Synthetic oligonucleotide
gcccgggcaggagcggcggc

SEQ ID NO: 170 - DNA, 20 bp, Artificial sequence
  Synthetic oligonucleotide
gcaggcgacagcagcagcag

SEQ ID NO: 171 - DNA, 20 bp, Artificial sequence
  Synthetic oligonucleotide
caggcgcaggcgacagcagc

SEQ ID NO: 172 - DNA, 20 bp, Artificial sequence
  Synthetic oligonucleotide
agcgaacatgacctccgcac

SEQ ID NO: 173 - DNA, 20 bp, Artificial sequence
  Synthetic oligonucleotide
aggagcgaacatgacctccg

SEQ ID NO: 174 - DNA, 20 bp, Artificial sequence
  Synthetic oligonucleotide
tgctaaggagcgaacatgac

SEQ ID NO: 175 - DNA, 20 bp, Artificial sequence
  Synthetic oligonucleotide
tgtccgtcgccccttctccc

SEQ ID NO: 176 - DNA, 20 bp, Artificial sequence
  Synthetic oligonucleotide
tgcgctcggctgtccgtcgc

SEQ ID NO: 177 - DNA, 20 bp, Artificial sequence
  Synthetic oligonucleotide
ccccatgcgctcggctgtcc

SEQ ID NO: 178 - DNA, 20 bp, Artificial sequence
  Synthetic oligonucleotide
gccctgcccgggccgccgcc

SEQ ID NO: 179 - DNA, 20 bp, Artificial sequence
  Synthetic oligonucleotide
gcagcatccagccctgcccg

SEQ ID NO: 180 - DNA, 20 bp, Artificial sequence
  Synthetic oligonucleotide
cccaggcagcatccagccct

SEQ ID NO: 181 - DNA, 20 bp, Artificial sequence
  Synthetic oligonucleotide
acctttggcacctcgcaccg

SEQ ID NO: 182 - DNA, 20 bp, Artificial sequence
  Synthetic oligonucleotide
gcccccggccgcgccggcgc

SEQ ID NO: 183 - DNA, 20 bp, Artificial sequence
  Synthetic oligonucleotide
cagtttcttgagcaccgagt

SEQ ID NO: 184 - DNA, 20 bp, Artificial sequence
  Synthetic oligonucleotide
gcctggagcagcagctccag

SEQ ID NO: 185 - DNA, 20 bp, Artificial sequence
  Synthetic oligonucleotide
ggctgcgcgccggcgggcgc

SEQ ID NO: 186 - DNA, 20 bp, Artificial sequence
  Synthetic oligonucleotide
cggctgcgcaggctgcgcgc

SEQ ID NO: 187 - DNA, 20 bp, Artificial sequence
  Synthetic oligonucleotide
acagcctcttgacttccgag

SEQ ID NO: 188 - DNA, 20 bp, Artificial sequence
  Synthetic oligonucleotide
aacacagcctcttgacttcc

SEQ ID NO: 189 - DNA, 20 bp, Artificial sequence
  Synthetic oligonucleotide
gagtcggctaaggtgatggg

SEQ ID NO: 190 - DNA, 20 bp, Artificial sequence
  Synthetic oligonucleotide
cccaggagggtatgcacact

SEQ ID NO: 191 - DNA, 20 bp, Artificial sequence
  Synthetic oligonucleotide
ctcccaggagggtatgcaca

SEQ ID NO: 192 - DNA, 20 bp, Artificial sequence
  Synthetic oligonucleotide
tctcccaggagggtatgcac

SEQ ID NO: 193 - DNA, 20 bp, Artificial sequence
  Synthetic oligonucleotide
tatgcacactctcccaggag

SEQ ID NO: 194 - DNA, 20 bp, Artificial sequence
  Synthetic oligonucleotide
agggtatgcacactctccca

SEQ ID NO: 195 - DNA, 20 bp, Artificial sequence
  Synthetic oligonucleotide
ggagggtatgcacactctcc

SEQ ID NO: 196 - DNA, 20 bp, Artificial sequence
  Synthetic oligonucleotide
cgtgattctccgtatttact

SEQ ID NO: 197 - DNA, 20 bp, Artificial sequence
  Synthetic oligonucleotide
ctctctttgccccaaaactc

SEQ ID NO: 198 - DNA, 20 bp, Artificial sequence
  Synthetic oligonucleotide
ttccatccaactctctttgc

SEQ ID NO: 199 - DNA, 20 bp, Artificial sequence
  Synthetic oligonucleotide
cggccttccatccaactctc

SEQ ID NO: 200 - DNA, 20 bp, Artificial sequence
  Synthetic oligonucleotide
ggataaaaggaaaggagttt

SEQ ID NO: 201 - DNA, 20 bp, Artificial sequence
  Synthetic oligonucleotide
gggctgcccattcctagcgc

SEQ ID NO: 202 - DNA, 20 bp, Artificial sequence
  Synthetic oligonucleotide
cgcacttcacagttcacagg

SEQ ID NO: 203 - DNA, 20 bp, Artificial sequence
  Synthetic oligonucleotide
tcgaatcaccctttccatta

SEQ ID NO: 204 - DNA, 20 bp, Artificial sequence
  Synthetic oligonucleotide
aaagttctagtgtctactcc

SEQ ID NO: 205 - DNA, 20 bp, Artificial sequence
  Synthetic oligonucleotide
actgacttgcaggtgactgg

SEQ ID NO: 206 - DNA, 20 bp, Artificial sequence
  Synthetic oligonucleotide
ccttctcccagaaccttggc

SEQ ID NO: 207 - DNA, 20 bp, Artificial sequence
  Synthetic oligonucleotide
agccaaaacccagtcaagtt

SEQ ID NO: 208 - DNA, 20 bp, Artificial sequence
  Synthetic oligonucleotide
aacatggcctttcttttcta

SEQ ID NO: 209 - DNA, 20 bp, Artificial sequence
  Synthetic oligonucleotide
gtcatgtgaacactctttca

SEQ ID NO: 210 - DNA, 20 bp, Artificial sequence
  Synthetic oligonucleotide
ctcaaacctttcagaccatc

SEQ ID NO: 211 - DNA, 20 bp, Artificial sequence
  Synthetic oligonucleotide
tgggtccctcaagagctcac

SEQ ID NO: 212 - DNA, 20 bp, Artificial sequence
  Synthetic oligonucleotide
gccactcctgactcacgcaa

SEQ ID NO: 213 - DNA, 20 bp, Artificial sequence
  Synthetic oligonucleotide
agacagatctctgaagtcag

SEQ ID NO: 214 - DNA, 20 bp, Artificial sequence
  Synthetic oligonucleotide
gccatacctccatctctcac

SEQ ID NO: 215 - DNA, 20 bp, Artificial sequence
  Synthetic oligonucleotide
acccccacattaaacataat

SEQ ID NO: 216 - DNA, 20 bp, Artificial sequence
  Synthetic oligonucleotide
ggacaacttttcaagaactc

SEQ ID NO: 217 - DNA, 20 bp, Artificial sequence
  Synthetic oligonucleotide
tggccatgctggcaaatagg

SEQ ID NO: 218 - DNA, 20 bp, Artificial sequence
  Synthetic oligonucleotide
ccaggcaaccccagacctgc

SEQ ID NO: 219 - DNA, 20 bp, Artificial sequence
  Synthetic oligonucleotide
attaccagtcccccattacg

SEQ ID NO: 220 - DNA, 20 bp, Artificial sequence
  Synthetic oligonucleotide
gcattaccagtcccccatta

SEQ ID NO: 221 - DNA, 20 bp, Artificial sequence
  Synthetic oligonucleotide
gtcacccgtctgggctccgg

SEQ ID NO: 222 - DNA, 20 bp, Artificial sequence
  Synthetic oligonucleotide
acagcaccttgtcacccgtc

SEQ ID NO: 223 - DNA, 20 bp, Artificial sequence
  Synthetic oligonucleotide
gtaagacagaccacagcacc

SEQ ID NO: 224 - DNA, 20 bp, Artificial sequence
  Synthetic oligonucleotide
cttgatgctgattattaatg

SEQ ID NO: 225 - DNA, 20 bp, Artificial sequence
  Synthetic oligonucleotide
caaaaggctgactcgcggcc

SEQ ID NO: 226 - DNA, 20 bp, Artificial sequence
  Synthetic oligonucleotide
cattccaaaaggctgactcg

SEQ ID NO: 227 - DNA, 20 bp, Artificial sequence
  Synthetic oligonucleotide
ctaaacagcatgaaagacaa

SEQ ID NO: 228 - DNA, 20 bp, Artificial sequence
  Synthetic oligonucleotide
taagcacgctctaaacagca

SEQ ID NO: 229 - DNA, 20 bp, Artificial sequence
  Synthetic oligonucleotide
atctttaagcacgctctaaa

SEQ ID NO: 230 - DNA, 20 bp, Artificial sequence
  Synthetic oligonucleotide
tacacaaataaaaacaccaa

SEQ ID NO: 231 - DNA, 20 bp, Artificial sequence
  Synthetic oligonucleotide
cagtctgctgtggatttgaa

SEQ ID NO: 232 - DNA, 20 bp, Artificial sequence
  Synthetic oligonucleotide
ctggacagtctgctgtggat

SEQ ID NO: 233 - DNA, 20 bp, Artificial sequence
  Synthetic oligonucleotide
acacttcacacaccaaagca

SEQ ID NO: 234 - DNA, 20 bp, Artificial sequence
  Synthetic oligonucleotide
ctgaagccccccaagccagg

SEQ ID NO: 235 - DNA, 20 bp, Artificial sequence
  Synthetic oligonucleotide
cctaaaggtgggtccattcc

SEQ ID NO: 236 - DNA, 20 bp, Artificial sequence
  Synthetic oligonucleotide
tcctcaggaacaacaatgct

SEQ ID NO: 237 - DNA, 20 bp, Artificial sequence
  Synthetic oligonucleotide
gaaaaacaggtagaaatagg

SEQ ID NO: 238 - DNA, 20 bp, Artificial sequence
  Synthetic oligonucleotide
aatgccaaatgcccaaaact

SEQ ID NO: 239 - DNA, 20 bp, Artificial sequence
  Synthetic oligonucleotide
acaaaccttccgaaaggacc

SEQ ID NO: 240 - DNA, 20 bp, Artificial sequence
  Synthetic oligonucleotide
taggactggaagagctttgg

SEQ ID NO: 241 - DNA, 20 bp, Artificial sequence
  Synthetic oligonucleotide
cccttcagagagtcactgct

SEQ ID NO: 242 - DNA, 20 bp, Artificial sequence
  Synthetic oligonucleotide
ccaactctgaacggaaagaa

SEQ ID NO: 243 - DNA, 20 bp, Artificial sequence
  Synthetic oligonucleotide
caaaactctctgccctggac

SEQ ID NO: 244 - DNA, 20 bp, Artificial sequence
  Synthetic oligonucleotide
gaggagggagaaactcctca

SEQ ID NO: 245 - DNA, 20 bp, Artificial sequence
  Synthetic oligonucleotide
gtttgcgcacgggattgtct

SEQ ID NO: 246 - DNA, 20 bp, Artificial sequence
  Synthetic oligonucleotide
gacacatccatgtccaagca

SEQ ID NO: 247 - DNA, 20 bp, Artificial sequence
  Synthetic oligonucleotide
cttccaacacatgctctgca

SEQ ID NO: 248 - DNA, 20 bp, Artificial sequence
  Synthetic oligonucleotide
gacagatgccagcaaggatc

SEQ ID NO: 249 - DNA, 20 bp, Artificial sequence
  Synthetic oligonucleotide
acaatgaataattgttcacg

SEQ ID NO: 250 - DNA, 20 bp, Artificial sequence
  Synthetic oligonucleotide
gccctcactccacaatggca

SEQ ID NO: 251 - DNA, 20 bp, Artificial sequence
  Synthetic oligonucleotide
ttaacccctgccggactgcc

SEQ ID NO: 252 - DNA, 20 bp, Artificial sequence
  Synthetic oligonucleotide
tccctttgctggcccagttc

SEQ ID NO: 253 - DNA, 20 bp, Artificial sequence
  Synthetic oligonucleotide
ctcccttttcactgctccac

SEQ ID NO: 254 - DNA, 20 bp, Artificial sequence
  Synthetic oligonucleotide
ggtcaaacttgtggtaaaat

SEQ ID NO: 255 - DNA, 20 bp, Artificial sequence
  Synthetic oligonucleotide
caccaaaacaagtgtctacc

SEQ ID NO: 256 - DNA, 20 bp, Artificial sequence
  Synthetic oligonucleotide
cttcccatgtgacctcaggg

SEQ ID NO: 257 - DNA, 20 bp, Artificial sequence
  Synthetic oligonucleotide
gccctagaacttgggcaagg

SEQ ID NO: 258 - DNA, 20 bp, Artificial sequence
  Synthetic oligonucleotide
tttaggtagagtggccggga

SEQ ID NO: 259 - DNA, 20 bp, Artificial sequence
  Synthetic oligonucleotide
cgatcattttctacaccttt

SEQ ID NO: 260 - DNA, 20 bp, Artificial sequence
  Synthetic oligonucleotide
tgttgaggactccccagcca

SEQ ID NO: 261 - DNA, 20 bp, Artificial sequence
  Synthetic oligonucleotide
gaactcctgcaggatgaggg

SEQ ID NO: 262 - DNA, 20 bp, Artificial sequence
  Synthetic oligonucleotide
cacagcaccgttactggaca

SEQ ID NO: 263 - DNA, 20 bp, Artificial sequence
  Synthetic oligonucleotide
gaaggaccaagtccctctcc

SEQ ID NO: 264 - DNA, 20 bp, Artificial sequence
  Synthetic oligonucleotide
catatttgctccataaacaa

SEQ ID NO: 265 - DNA, 20 bp, Artificial sequence
  Synthetic oligonucleotide
catcaccttcggacaagcca

SEQ ID NO: 266 - DNA, 20 bp, Artificial sequence
  Synthetic oligonucleotide
agatttaaaattaaaaagca

SEQ ID NO: 267 - DNA, 20 bp, Artificial sequence
  Synthetic oligonucleotide
tccccgccttttcttcctgg

SEQ ID NO: 268 - DNA, 20 bp, Artificial sequence
  Synthetic oligonucleotide
tcccgactttgcaagatgaa

SEQ ID NO: 269 - DNA, 20 bp, Artificial sequence
  Synthetic oligonucleotide
ctggctcagaggctgcagtg

SEQ ID NO: 270 - DNA, 20 bp, Artificial sequence
  Synthetic oligonucleotide
tcttccccagaaaacagccc

SEQ ID NO: 271 - DNA, 20 bp, Artificial sequence
  Synthetic oligonucleotide
ccagccccctcctgggacta

SEQ ID NO: 272 - DNA, 20 bp, Artificial sequence
  Synthetic oligonucleotide
ggaggcaaattcatagacag

SEQ ID NO: 273 - DNA, 20 bp, Artificial sequence
  Synthetic oligonucleotide
aggcacaagtcaaggaggcc

SEQ ID NO: 274 - DNA, 20 bp, Artificial sequence
  Synthetic oligonucleotide
ctccctctgccccaggattc

SEQ ID NO: 275 - DNA, 20 bp, Artificial sequence
  Synthetic oligonucleotide
cgagctccctccctggcccc

SEQ ID NO: 276 - DNA, 20 bp, Artificial sequence
  Synthetic oligonucleotide
cagtttctagagggtaggaa

SEQ ID NO: 277 - DNA, 20 bp, Artificial sequence
  Synthetic oligonucleotide
aggacccaaaggcagaccct

SEQ ID NO: 278 - DNA, 20 bp, Artificial sequence
  Synthetic oligonucleotide
ctgccaccctgagagtgtag

SEQ ID NO: 279 - DNA, 20 bp, Artificial sequence
  Synthetic oligonucleotide
aaccaggttcccactgttac

SEQ ID NO: 280 - DNA, 20 bp, Artificial sequence
  Synthetic oligonucleotide
cagccactgctgtctgagga

SEQ ID NO: 281 - DNA, 20 bp, Artificial sequence
  Synthetic oligonucleotide
ctgaagtttctcctcccatc

SEQ ID NO: 282 - DNA, 20 bp, Artificial sequence
  Synthetic oligonucleotide
caaaagggaaaggaggtttg

SEQ ID NO: 283 - DNA, 20 bp, Artificial sequence
  Synthetic oligonucleotide
atttgcaacaataaaacaaa

SEQ ID NO: 284 - DNA, 20 bp, Artificial sequence
  Synthetic oligonucleotide
atgcccaccagtcttcctga

SEQ ID NO: 285 - DNA, 20 bp, Artificial sequence
  Synthetic oligonucleotide
gggttctccagccgctcaga

SEQ ID NO: 286 - DNA, 20 bp, Artificial sequence
  Synthetic oligonucleotide
tgccaaccccagaggtgagc

SEQ ID NO: 287 - DNA, 20 bp, Artificial sequence
  Synthetic oligonucleotide
caaacatcaccacgcctcgc

SEQ ID NO: 288 - DNA, 20 bp, Artificial sequence
  Synthetic oligonucleotide
aggcacggccgcctcctgca

SEQ ID NO: 289 - DNA, 20 bp, Artificial sequence
  Synthetic oligonucleotide
atggtccagcagagcagaag

SEQ ID NO: 290 - DNA, 20 bp, Artificial sequence
  Synthetic oligonucleotide
ccttcttaaatttttaattt

SEQ ID NO: 291 - DNA, 20 bp, Artificial sequence
  Synthetic oligonucleotide
aaggccacattttaggttaa

SEQ ID NO: 292 - DNA, 20 bp, Artificial sequence
  Synthetic oligonucleotide
caatggcacagggtgaccag

SEQ ID NO: 293 - DNA, 20 bp, Artificial sequence
  Synthetic oligonucleotide
tcgctgatagttaacctctg

SEQ ID NO: 294 - DNA, 20 bp, Artificial sequence
  Synthetic oligonucleotide
acaaaggtctgtgtggacgc

SEQ ID NO: 295 - DNA, 20 bp, Artificial sequence
  Synthetic oligonucleotide
gcccacagcccacacgagtc

SEQ ID NO: 296 - DNA, 20 bp, Artificial sequence
  Synthetic oligonucleotide
cgaggtgcccccatgccagg

SEQ ID NO: 297 - DNA, 20 bp, Artificial sequence
  Synthetic oligonucleotide
ctggaaaggaagactcgagg

SEQ ID NO: 298 - DNA, 20 bp, Artificial sequence
  Synthetic oligonucleotide
ggaaggacacattggcatca

SEQ ID NO: 299 - DNA, 20 bp, Artificial sequence
  Synthetic oligonucleotide
tcctgctgccccagcaggct

SEQ ID NO: 300 - DNA, 20 bp, Artificial sequence
  Synthetic oligonucleotide
gtcggtcagggccttgccct

SEQ ID NO: 301 - DNA, 20 bp, Artificial sequence
  Synthetic oligonucleotide
gtatttgttaacaaaaatgg

SEQ ID NO: 302 - DNA, 20 bp, Artificial sequence
  Synthetic oligonucleotide
cacccagctctcaaatcagt

SEQ ID NO: 303 - DNA, 20 bp, Artificial sequence
  Synthetic oligonucleotide
atgcaaagggacccttaata

SEQ ID NO: 304 - DNA, 20 bp, Artificial sequence
  Synthetic oligonucleotide
ctgcagagcacagatgcaaa

SEQ ID NO: 305 - DNA, 20 bp, Artificial sequence
  Synthetic oligonucleotide
gtagagcctccccactctcg

SEQ ID NO: 306 - DNA, 20 bp, Artificial sequence
  Synthetic oligonucleotide
ggctcctggacacagtagag

SEQ ID NO: 307 - DNA, 20 bp, Artificial sequence
  Synthetic oligonucleotide
gagagggctcctggacacag

SEQ ID NO: 308 - DNA, 20 bp, Artificial sequence
  Synthetic oligonucleotide
ttctgcaccagctgactctt

SEQ ID NO: 309 - DNA, 20 bp, Artificial sequence
  Synthetic oligonucleotide
gctccgcaccttctgcacca

SEQ ID NO: 310 - DNA, 20 bp, Artificial sequence
  Synthetic oligonucleotide
attttgctccgcaccttctg

SEQ ID NO: 311 - DNA, 20 bp, Artificial sequence
  Synthetic oligonucleotide
tgcggttgtacacccacaca

SEQ ID NO: 312 - DNA, 20 bp, Artificial sequence
  Synthetic oligonucleotide
gggaacaccttgtgtaccaa

SEQ ID NO: 313 - DNA, 20 bp, Artificial sequence
  Synthetic oligonucleotide
agccttgatggagaaaccgg

SEQ ID NO: 314 - DNA, 20 bp, Artificial sequence
  Synthetic oligonucleotide
aagcccgtccacggctgctg

SEQ ID NO: 315 - DNA, 20 bp, Artificial sequence
  Synthetic oligonucleotide
ctgcacggtaaagcccgtcc

SEQ ID NO: 316 - DNA, 20 bp, Artificial sequence
  Synthetic oligonucleotide
ctgatctgcacggtaaagcc

SEQ ID NO: 317 - DNA, 20 bp, Artificial sequence
  Synthetic oligonucleotide
cgggcagctgctgatgaact

SEQ ID NO: 318 - DNA, 20 bp, Artificial sequence
  Synthetic oligonucleotide
ctagccagcacgggcagctg

SEQ ID NO: 319 - DNA, 20 bp, Artificial sequence
  Synthetic oligonucleotide
tgacctctagccagcacggg

SEQ ID NO: 320 - DNA, 20 bp, Artificial sequence
  Synthetic oligonucleotide
gcacgcggctaccggctgtt

SEQ ID NO: 321 - DNA, 20 bp, Artificial sequence
  Synthetic oligonucleotide
gctcacgctctgtcccctcc

SEQ ID NO: 322 - DNA, 20 bp, Artificial sequence
  Synthetic oligonucleotide
cagctcacgctctgtcccct

SEQ ID NO: 323 - DNA, 20 bp, Artificial sequence
  Synthetic oligonucleotide
cctgctcagctcacgctctg

SEQ ID NO: 324 - DNA, 20 bp, Artificial sequence
  Synthetic oligonucleotide
agtgtggcctgctcagctca

SEQ ID NO: 325 - DNA, 20 bp, Artificial sequence
  Synthetic oligonucleotide
tttgaagtgtggcctgctca

SEQ ID NO: 326 - DNA, 20 bp, Artificial sequence
  Synthetic oligonucleotide
gaggaaaatattagcagcaa

SEQ ID NO: 327 - DNA, 20 bp, Artificial sequence
  Synthetic oligonucleotide
aagcactcaggaggaaaata

SEQ ID NO: 328 - DNA, 20 bp, Artificial sequence
  Synthetic oligonucleotide
aaagcaagcactcaggagga

SEQ ID NO: 329 - DNA, 20 bp, Artificial sequence
  Synthetic oligonucleotide
ttgcatgaaaagcaagcact

SEQ ID NO: 330 - DNA, 20 bp, Artificial sequence
  Synthetic oligonucleotide
gtttgcatgaaaagcaagca

SEQ ID NO: 331 - DNA, 20 bp, Artificial sequence
  Synthetic oligonucleotide
gagtttgcatgaaaagcaag

SEQ ID NO: 332 - DNA, 20 bp, Artificial sequence
  Synthetic oligonucleotide
agaagaaaaccaaccaacaa

SEQ ID NO: 333 - DNA, 20 bp, Artificial sequence
  Synthetic oligonucleotide
aacagaacacaaacgaggac

SEQ ID NO: 334 - DNA, 20 bp, Artificial sequence
  Synthetic oligonucleotide
aacaaaacagaacacaaacg

SEQ ID NO: 335 - DNA, 20 bp, Artificial sequence
  Synthetic oligonucleotide
tcataagctatttctcaaag

SEQ ID NO: 336 - DNA, 20 bp, Artificial sequence
  Synthetic oligonucleotide
acaattcttttcataagcta

SEQ ID NO: 337 - DNA, 20 bp, Artificial sequence
  Synthetic oligonucleotide
ccccaacaattcttttcata

SEQ ID NO: 338 - DNA, 20 bp, Artificial sequence
  Synthetic oligonucleotide
ggtgtcctgccgatcatacc

SEQ ID NO: 339 - DNA, 20 bp, Artificial sequence
  Synthetic oligonucleotide
tgcttcccctcttcctatca

SEQ ID NO: 340 - DNA, 20 bp, Artificial sequence
  Synthetic oligonucleotide
atttctgcttcccctcttcc

SEQ ID NO: 341 - DNA, 20 bp, Artificial sequence
  Synthetic oligonucleotide
cccttcatacactgtgtttg

SEQ ID NO: 342 - DNA, 20 bp, Artificial sequence
  Synthetic oligonucleotide
aaatgatgaccgcccccctt

SEQ ID NO: 343 - DNA, 20 bp, Artificial sequence
  Synthetic oligonucleotide
aagtgaaatgatgaccgccc

SEQ ID NO: 344 - DNA, 20 bp, Artificial sequence
  Synthetic oligonucleotide
gccgcacactcacactcaca

SEQ ID NO: 345 - DNA, 20 bp, Artificial sequence
  Synthetic oligonucleotide
gacacaaaacaaagagcacg

SEQ ID NO: 346 - DNA, 20 bp, Artificial sequence
  Synthetic oligonucleotide
gggacatccataagagacac

SEQ ID NO: 347 - DNA, 20 bp, Artificial sequence
  Synthetic oligonucleotide
cttgggactgcaaacctctc

SEQ ID NO: 348 - DNA, 20 bp, Artificial sequence
  Synthetic oligonucleotide
cgcttgggactgcaaacctc

SEQ ID NO: 349 - DNA, 20 bp, Artificial sequence
  Synthetic oligonucleotide
accgcttgggactgcaaacc

SEQ ID NO: 350 - DNA, 20 bp, Artificial sequence
  Synthetic oligonucleotide
agcttgcccaggtactgcct

SEQ ID NO: 351 - DNA, 20 bp, Artificial sequence
  Synthetic oligonucleotide
ctggcagctgctgggacccc

SEQ ID NO: 352 - DNA, 20 bp, Artificial sequence
  Synthetic oligonucleotide
tgctcctggcagctgctggg

SEQ ID NO: 353 - DNA, 20 bp, Artificial sequence
  Synthetic oligonucleotide
aggcccgtgtccttgatgag

SEQ ID NO: 354 - DNA, 20 bp, Artificial sequence
  Synthetic oligonucleotide
gcctgtggacaggcccgtgt

SEQ ID NO: 355 - DNA, 20 bp, Artificial sequence
  Synthetic oligonucleotide
cagaagcctgtggacaggcc

SEQ ID NO: 356 - DNA, 20 bp, Artificial sequence
  Synthetic oligonucleotide
gacaaggatgaaaataattg

SEQ ID NO: 357 - DNA, 20 bp, Artificial sequence
  Synthetic oligonucleotide
gaagggaataagacaaggat

SEQ ID NO: 358 - DNA, 20 bp, Artificial sequence
  Synthetic oligonucleotide
gcaggaagggaataagacaa

SEQ ID NO: 359 - DNA, 20 bp, Artificial sequence
  Synthetic oligonucleotide
ccttgggaagcccatctcag

SEQ ID NO: 360 - DNA, 20 bp, Artificial sequence
  Synthetic oligonucleotide
gggctgccccggcagccctt

SEQ ID NO: 361 - DNA, 20 bp, Artificial sequence
  Synthetic oligonucleotide
ggtgagcaatactgtgaggg

SEQ ID NO: 362 - DNA, 20 bp, Artificial sequence
  Synthetic oligonucleotide
tccgggaaaaacctgatgtc

SEQ ID NO: 363 - DNA, 20 bp, Artificial sequence
  Synthetic oligonucleotide
gttttctaagtccgggaaaa

SEQ ID NO: 364 - DNA, 20 bp, Artificial sequence
  Synthetic oligonucleotide
agctggttttctaagtccgg

SEQ ID NO: 365 - DNA, 20 bp, Artificial sequence
  Synthetic oligonucleotide
cacacaggatgggagcaggc

SEQ ID NO: 366 - DNA, 20 bp, Artificial sequence
  Synthetic oligonucleotide
aacacacaggatgggagcag

SEQ ID NO: 367 - DNA, 20 bp, Artificial sequence
  Synthetic oligonucleotide
taacacacaggatgggagca

SEQ ID NO: 368 - DNA, 20 bp, Artificial sequence
  Synthetic oligonucleotide
ccagggacatccccgcttgc

SEQ ID NO: 369 - DNA, 20 bp, Artificial sequence
  Synthetic oligonucleotide
tgctaagcatgtccctccca

SEQ ID NO: 370 - DNA, 20 bp, Artificial sequence
  Synthetic oligonucleotide
gggactgctaagcatgtccc

SEQ ID NO: 371 - DNA, 20 bp, Artificial sequence
  Synthetic oligonucleotide
ccttgggttatgacggacca

SEQ ID NO: 372 - DNA, 20 bp, Artificial sequence
  Synthetic oligonucleotide
taggatggtaccttgggtta

SEQ ID NO: 373 - DNA, 20 bp, Artificial sequence
  Synthetic oligonucleotide
cagcctaggatggtaccttg

SEQ ID NO: 374 - DNA, 20 bp, Artificial sequence
  Synthetic oligonucleotide
gaagaaatgaaagaagagtt

SEQ ID NO: 375 - DNA, 20 bp, Artificial sequence
  Synthetic oligonucleotide
tatgagttgtagaagaaatg

SEQ ID NO: 376 - DNA, 20 bp, Artificial sequence
  Synthetic oligonucleotide
gagtgtatgagttgtagaag

SEQ ID NO: 377 - DNA, 20 bp, Artificial sequence
  Synthetic oligonucleotide
attgagctaagaacagtgtc

SEQ ID NO: 378 - DNA, 20 bp, Artificial sequence
  Synthetic oligonucleotide
aaacatgctcattgagctaa

SEQ ID NO: 379 - DNA, 20 bp, Artificial sequence
  Synthetic oligonucleotide
agtctaaacatgctcattga

SEQ ID NO: 380 - DNA, 20 bp, Artificial sequence
  Synthetic oligonucleotide
ttctcttgttcatttaaacc

SEQ ID NO: 381 - DNA, 20 bp, Artificial sequence
  Synthetic oligonucleotide
atgagaatgcttctcttgtt

SEQ ID NO: 382 - DNA, 20 bp, Artificial sequence
  Synthetic oligonucleotide
ttccaatgagaatgcttctc

SEQ ID NO: 383 - DNA, 20 bp, Artificial sequence
  Synthetic oligonucleotide
ctctcaaagcactacaatgc

SEQ ID NO: 384 - DNA, 20 bp, Artificial sequence
  Synthetic oligonucleotide
agtcctttctctctcaaagc

SEQ ID NO: 385 - DNA, 20 bp, Artificial sequence
  Synthetic oligonucleotide
tcaggagtcctttctctctc

SEQ ID NO: 386 - DNA, 20 bp, Artificial sequence
  Synthetic oligonucleotide
tgtttatacacattgcacaa

SEQ ID NO: 387 - DNA, 20 bp, Artificial sequence
  Synthetic oligonucleotide
ttatttttcttgtttataca

SEQ ID NO: 388 - DNA, 20 bp, Artificial sequence
  Synthetic oligonucleotide
gcatcttttctttatttttc

SEQ ID NO: 389 - DNA, 20 bp, Artificial sequence
  Synthetic oligonucleotide
atttggcatttgttatttgc

SEQ ID NO: 390 - DNA, 20 bp, Artificial sequence
  Synthetic oligonucleotide
gtttatcttttttaatttgg

SEQ ID NO: 391 - DNA, 20 bp, Artificial sequence
  Synthetic oligonucleotide
cttgtgtttatcttttttaa

SEQ ID NO: 392 - DNA, 20 bp, Artificial sequence
  Synthetic oligonucleotide
gccaatatcataacccaagc

SEQ ID NO: 393 - DNA, 20 bp, Artificial sequence
  Synthetic oligonucleotide
atctggacagtctgcagttg

SEQ ID NO: 394 - DNA, 20 bp, Artificial sequence
  Synthetic oligonucleotide
gcgccctgcgcggctctccg

SEQ ID NO: 395 - DNA, 20 bp, Artificial sequence
  Synthetic oligonucleotide
caccccgcgcggcccgcgcc

SEQ ID NO: 396 - DNA, 20 bp, Artificial sequence
  Synthetic oligonucleotide
gcgctccggctgccccaccc

SEQ ID NO: 397 - DNA, 20 bp, Artificial sequence
  Synthetic oligonucleotide
ctgcgctccggctgccccac

SEQ ID NO: 398 - DNA, 20 bp, Artificial sequence
  Synthetic oligonucleotide
gagcggcggcggcccgaggg

SEQ ID NO: 399 - DNA, 20 bp, Artificial sequence
  Synthetic oligonucleotide
acatgacctccgcacaccat

SEQ ID NO: 400 - DNA, 20 bp, Artificial sequence
  Synthetic oligonucleotide
gaacatgacctccgcacacc

SEQ ID NO: 401 - DNA, 20 bp, Artificial sequence
  Synthetic oligonucleotide
cgaacatgacctccgcacac

SEQ ID NO: 402 - DNA, 20 bp, Artificial sequence
  Synthetic oligonucleotide
cccctgcgccctcctcctcg

SEQ ID NO: 403 - DNA, 20 bp, Artificial sequence
  Synthetic oligonucleotide
gctcgcctcctcctccacct

SEQ ID NO: 404 - DNA, 20 bp, Artificial sequence
  Synthetic oligonucleotide
ccttctccccgcagctcgcc

SEQ ID NO: 405 - DNA, 20 bp, Artificial sequence
  Synthetic oligonucleotide
accggccccatgcgctcggc

SEQ ID NO: 406 - DNA, 20 bp, Artificial sequence
  Synthetic oligonucleotide
ccgccaccggccccatgcgc

SEQ ID NO: 407 - DNA, 20 bp, Artificial sequence
  Synthetic oligonucleotide
ggccgccgccaccggcccca

SEQ ID NO: 408 - DNA, 20 bp, Artificial sequence
  Synthetic oligonucleotide
ccttgcccaggcagcatcca

SEQ ID NO: 409 - DNA, 20 bp, Artificial sequence
  Synthetic oligonucleotide
caccgccttgcccaggcagc

SEQ ID NO: 410 - DNA, 20 bp, Artificial sequence
  Synthetic oligonucleotide
cctcgcaccgccttgcccag

SEQ ID NO: 411 - DNA, 20 bp, Artificial sequence
  Synthetic oligonucleotide
tccttcagtttcttgagcac

SEQ ID NO: 412 - DNA, 20 bp, Artificial sequence
  Synthetic oligonucleotide
gccgctccttcagtttcttg

SEQ ID NO: 413 - DNA, 20 bp, Artificial sequence
  Synthetic oligonucleotide
cagctgccgctccttcagtt

SEQ ID NO: 414 - DNA, 20 bp, Artificial sequence
  Synthetic oligonucleotide
cgagggcggctgcgcaggct

SEQ ID NO: 415 - DNA, 20 bp, Artificial sequence
  Synthetic oligonucleotide
ctcttgacttccgaggaatg

SEQ ID NO: 416 - DNA, 20 bp, Artificial sequence
  Synthetic oligonucleotide
gcctcttgacttccgaggaa

SEQ ID NO: 417 - DNA, 20 bp, Artificial sequence
  Synthetic oligonucleotide
tcgcagagtcggctaaggtg

SEQ ID NO: 418 - DNA, 20 bp, Artificial sequence
  Synthetic oligonucleotide
ctagttcgcagagtcggcta

SEQ ID NO: 419 - DNA, 20 bp, Artificial sequence
  Synthetic oligonucleotide
cctagttcgcagagtcggct

SEQ ID NO: 420 - DNA, 20 bp, Artificial sequence
  Synthetic oligonucleotide
ctctcccaggagggtatgca

SEQ ID NO: 421 - DNA, 20 bp, Artificial sequence
  Synthetic oligonucleotide
cactctcccaggagggtatg

SEQ ID NO: 422 - DNA, 20 bp, Artificial sequence
  Synthetic oligonucleotide
cacactctcccaggagggta

SEQ ID NO: 423 - DNA, 20 bp, Artificial sequence
  Synthetic oligonucleotide
caggagggtatgcacactct

SEQ ID NO: 424 - DNA, 20 bp, Artificial sequence
  Synthetic oligonucleotide
aatgccctttgagtttcccc

SEQ ID NO: 425 - DNA, 20 bp, Artificial sequence
  Synthetic oligonucleotide
gggcctggaccaaatccaac

SEQ ID NO: 426 - DNA, 20 bp, Artificial sequence
  Synthetic oligonucleotide
tgggccactggtgttcgacg

SEQ ID NO: 427 - DNA, 20 bp, Artificial sequence
  Synthetic oligonucleotide
ggccacgacagtatctgggc

SEQ ID NO: 428 - DNA, 20 bp, Artificial sequence
  Synthetic oligonucleotide
actccaaaggtgcgcggcca

SEQ ID NO: 429 - DNA, 20 bp, Artificial sequence
  Synthetic oligonucleotide
cagttcggccttccatccaa

SEQ ID NO: 430 - DNA, 20 bp, Artificial sequence
  Synthetic oligonucleotide
attcttttagcccaactgtt

SEQ ID NO: 431 - DNA, 20 bp, Artificial sequence
  Synthetic oligonucleotide
tgcctacacacaaaaagcca

SEQ ID NO: 432 - DNA, 20 bp, Artificial sequence
  Synthetic oligonucleotide
tctggactaaagcttccacg

SEQ ID NO: 433 - DNA, 20 bp, Artificial sequence
  Synthetic oligonucleotide
caggcagagctatgcttcaa

SEQ ID NO: 434 - DNA, 20 bp, Artificial sequence
  Synthetic oligonucleotide
cccagcactgtgatgtccag

SEQ ID NO: 435 - DNA, 20 bp, Artificial sequence
  Synthetic oligonucleotide
agagggagctccaggaattt

SEQ ID NO: 436 - DNA, 20 bp, Artificial sequence
  Synthetic oligonucleotide
aacttttctcccccttggaa

SEQ ID NO: 437 - DNA, 20 bp, Artificial sequence
  Synthetic oligonucleotide
tgctccagctccagacctgg

SEQ ID NO: 438 - DNA, 20 bp, Artificial sequence
  Synthetic oligonucleotide
aatgcccccggccacagcag

SEQ ID NO: 439 - DNA, 20 bp, Artificial sequence
  Synthetic oligonucleotide
tgccagatctcaggtcaaga

SEQ ID NO: 440 - DNA, 20 bp, Artificial sequence
  Synthetic oligonucleotide
tcaaatgaaccctggttata

SEQ ID NO: 441 - DNA, 20 bp, Artificial sequence
  Synthetic oligonucleotide
gagcttcctaagtactgtta

SEQ ID NO: 442 - DNA, 20 bp, Artificial sequence
  Synthetic oligonucleotide
ggctattcccaagagtccag

SEQ ID NO: 443 - DNA, 20 bp, Artificial sequence
  Synthetic oligonucleotide
gtgaagaagcaaagtatacc

SEQ ID NO: 444 - DNA, 20 bp, Artificial sequence
  Synthetic oligonucleotide
aagccgggcatctcagagca

SEQ ID NO: 445 - DNA, 20 bp, Artificial sequence
  Synthetic oligonucleotide
aatgtccctgtgggtttcca

SEQ ID NO: 446 - DNA, 20 bp, Artificial sequence
  Synthetic oligonucleotide
gtccatgaaccacaactcat

SEQ ID NO: 447 - DNA, 20 bp, Artificial sequence
  Synthetic oligonucleotide
ccctcaggtactctgcacag

SEQ ID NO: 448 - DNA, 20 bp, Artificial sequence
  Synthetic oligonucleotide
gagtcaggctcaatgagact

SEQ ID NO: 449 - DNA, 20 bp, Artificial sequence
  Synthetic oligonucleotide
tcaggcttcactgcccatcg

SEQ ID NO: 450 - DNA, 20 bp, Artificial sequence
  Synthetic oligonucleotide
taatggtctgctcaggcttc

SEQ ID NO: 451 - DNA, 20 bp, Artificial sequence
  Synthetic oligonucleotide
attattaatggtctgctcag

SEQ ID NO: 452 - DNA, 20 bp, Artificial sequence
  Synthetic oligonucleotide
ccacacattccaaaaggctg

SEQ ID NO: 453 - DNA, 20 bp, Artificial sequence
  Synthetic oligonucleotide
acaaaccacacattccaaaa

SEQ ID NO: 454 - DNA, 20 bp, Artificial sequence
  Synthetic oligonucleotide
gaaagacaaaccacacattc

SEQ ID NO: 455 - DNA, 20 bp, Artificial sequence
  Synthetic oligonucleotide
gatccatctttaagcacgct

SEQ ID NO: 456 - DNA, 20 bp, Artificial sequence
  Synthetic oligonucleotide
accaagatccatctttaagc

SEQ ID NO: 457 - DNA, 20 bp, Artificial sequence
  Synthetic oligonucleotide
aaaacaccaagatccatctt

SEQ ID NO: 458 - DNA, 20 bp, Artificial sequence
  Synthetic oligonucleotide
agcatctggacagtctgctg

SEQ ID NO: 459 - DNA, 20 bp, Artificial sequence
  Synthetic oligonucleotide
atcttacctgaaagcccccc

SEQ ID NO: 460 - DNA, 20 bp, Artificial sequence
  Synthetic oligonucleotide
ccccattcctccagtcttta

SEQ ID NO: 461 - DNA, 20 bp, Artificial sequence
  Synthetic oligonucleotide
gtcaccaccgatgcatccaa

SEQ ID NO: 462 - DNA, 20 bp, Artificial sequence
  Synthetic oligonucleotide
gtatgcttgggatctgtctt

SEQ ID NO: 463 - DNA, 20 bp, Artificial sequence
  Synthetic oligonucleotide
ggctgggaatcagaacttgg

SEQ ID NO: 464 - DNA, 20 bp, Artificial sequence
  Synthetic oligonucleotide
ctgttggcagtgctcccacc

SEQ ID NO: 465 - DNA, 20 bp, Artificial sequence
  Synthetic oligonucleotide
ctcagcaagctcagttcctg

SEQ ID NO: 466 - DNA, 20 bp, Artificial sequence
  Synthetic oligonucleotide
ccctcagtctcagataacag

SEQ ID NO: 467 - DNA, 20 bp, Artificial sequence
  Synthetic oligonucleotide
tgagtaaacaataccctcag

SEQ ID NO: 468 - DNA, 20 bp, Artificial sequence
  Synthetic oligonucleotide
taaatcaagagctgaaattc

SEQ ID NO: 469 - DNA, 20 bp, Artificial sequence
  Synthetic oligonucleotide
actttgaagcctttggaatt

SEQ ID NO: 470 - DNA, 20 bp, Artificial sequence
  Synthetic oligonucleotide
agctcaaactttgaagcctt

SEQ ID NO: 471 - DNA, 20 bp, Artificial sequence
  Synthetic oligonucleotide
agcacaccccacccccacct

SEQ ID NO: 472 - DNA, 20 bp, Artificial sequence
  Synthetic oligonucleotide
aagtccctaacgaccaggcc

SEQ ID NO: 473 - DNA, 20 bp, Artificial sequence
  Synthetic oligonucleotide
gaagcaagtcactgccttct

SEQ ID NO: 474 - DNA, 20 bp, Artificial sequence
  Synthetic oligonucleotide
gacagcagacaggcaaaatg

SEQ ID NO: 475 - DNA, 20 bp, Artificial sequence
  Synthetic oligonucleotide
acctacaactcacaagggag

SEQ ID NO: 476 - DNA, 20 bp, Artificial sequence
  Synthetic oligonucleotide
ccttgagatccatgggagca

SEQ ID NO: 477 - DNA, 20 bp, Artificial sequence
  Synthetic oligonucleotide
ccccaaagtccacgctcatg

SEQ ID NO: 478 - DNA, 20 bp, Artificial sequence
  Synthetic oligonucleotide
acctgagtcccccaaagtcc

SEQ ID NO: 479 - DNA, 20 bp, Artificial sequence
  Synthetic oligonucleotide
ggcactgcagaagaggcggg

SEQ ID NO: 480 - DNA, 20 bp, Artificial sequence
  Synthetic oligonucleotide
atccaactactcagaggctg

SEQ ID NO: 481 - DNA, 20 bp, Artificial sequence
  Synthetic oligonucleotide
ggaattatgacacagtaaca

SEQ ID NO: 482 - DNA, 20 bp, Artificial sequence
  Synthetic oligonucleotide
tgaagacaactgctttgaga

SEQ ID NO: 483 - DNA, 20 bp, Artificial sequence
  Synthetic oligonucleotide
ttctactagaaaaaaattag

SEQ ID NO: 484 - DNA, 20 bp, Artificial sequence
  Synthetic oligonucleotide
ctctcatttctggaacccac

SEQ ID NO: 485 - DNA, 20 bp, Artificial sequence
  Synthetic oligonucleotide
caccatcctggttcgcagtc

SEQ ID NO: 486 - DNA, 20 bp, Artificial sequence
  Synthetic oligonucleotide
acctttcacgaaccactttt

SEQ ID NO: 487 - DNA, 20 bp, Artificial sequence
  Synthetic oligonucleotide
ttaaagaaaatggcctacat

SEQ ID NO: 488 - DNA, 20 bp, Artificial sequence
  Synthetic oligonucleotide
aacataaagttctcaaacag

SEQ ID NO: 489 - DNA, 20 bp, Artificial sequence
  Synthetic oligonucleotide
agatgcttctaggtgaacca

SEQ ID NO: 490 - DNA, 20 bp, Artificial sequence
  Synthetic oligonucleotide
tttagaaacccagagacaaa

SEQ ID NO: 491 - DNA, 20 bp, Artificial sequence
  Synthetic oligonucleotide
ttgtgttatgaaaacaaaac

SEQ ID NO: 492 - DNA, 20 bp, Artificial sequence
  Synthetic oligonucleotide
ccacacaaccaaagcagaag

SEQ ID NO: 493 - DNA, 20 bp, Artificial sequence
  Synthetic oligonucleotide
ctaggctggtcacttccact

SEQ ID NO: 494 - DNA, 20 bp, Artificial sequence
  Synthetic oligonucleotide
tcccacttctcctctggctg

SEQ ID NO: 495 - DNA, 20 bp, Artificial sequence
  Synthetic oligonucleotide
ctgaaagaaagtcccgactt

SEQ ID NO: 496 - DNA, 20 bp, Artificial sequence
  Synthetic oligonucleotide
cgtcttattgtttttgttcc

SEQ ID NO: 497 - DNA, 20 bp, Artificial sequence
  Synthetic oligonucleotide
ctgccaacggcacagtcata

SEQ ID NO: 498 - DNA, 20 bp, Artificial sequence
  Synthetic oligonucleotide
agacaaagatcacagatcac

SEQ ID NO: 499 - DNA, 20 bp, Artificial sequence
  Synthetic oligonucleotide
atagggatatctcatcaata

SEQ ID NO: 500 - DNA, 20 bp, Artificial sequence
  Synthetic oligonucleotide
gcatttttctgaacagagtc

SEQ ID NO: 501 - DNA, 20 bp, Artificial sequence
  Synthetic oligonucleotide
tcccccaccgcgcagggaca

SEQ ID NO: 502 - DNA, 20 bp, Artificial sequence
  Synthetic oligonucleotide
agctgctgtcacaaggccct

SEQ ID NO: 503 - DNA, 20 bp, Artificial sequence
  Synthetic oligonucleotide
attacttctgtctgcctccg

SEQ ID NO: 504 - DNA, 20 bp, Artificial sequence
  Synthetic oligonucleotide
tccctggttttgcaggtggt

SEQ ID NO: 505 - DNA, 20 bp, Artificial sequence
  Synthetic oligonucleotide
attttccaaaaggacaaaac

SEQ ID NO: 506 - DNA, 20 bp, Artificial sequence
  Synthetic oligonucleotide
gcatcatgaaaatcttaata

SEQ ID NO: 507 - DNA, 20 bp, Artificial sequence
  Synthetic oligonucleotide
tcgccatggagaatgtaatt

SEQ ID NO: 508 - DNA, 20 bp, Artificial sequence
  Synthetic oligonucleotide
taagagcatttatctcgcca

SEQ ID NO: 509 - DNA, 20 bp, Artificial sequence
  Synthetic oligonucleotide
agtctgaagcccccaacctg

SEQ ID NO: 510 - DNA, 20 bp, Artificial sequence
  Synthetic oligonucleotide
gggcccccttctgccttcat

SEQ ID NO: 511 - DNA, 20 bp, Artificial sequence
  Synthetic oligonucleotide
ctctcagggtctcagtttga

SEQ ID NO: 512 - DNA, 20 bp, Artificial sequence
  Synthetic oligonucleotide
ggtgtgagctgtggacacag

SEQ ID NO: 513 - DNA, 20 bp, Artificial sequence
  Synthetic oligonucleotide
cccaacccatctccaccacc

SEQ ID NO: 514 - DNA, 20 bp, Artificial sequence
  Synthetic oligonucleotide
taggcgaatccctcccccaa

SEQ ID NO: 515 - DNA, 20 bp, Artificial sequence
  Synthetic oligonucleotide
acccttgctggtctcttgtt

SEQ ID NO: 516 - DNA, 20 bp, Artificial sequence
  Synthetic oligonucleotide
atattcctctgccaaagtcc

SEQ ID NO: 517 - DNA, 20 bp, Artificial sequence
  Synthetic oligonucleotide
aaaaaagccagtaaagacat

SEQ ID NO: 518 - DNA, 20 bp, Artificial sequence
  Synthetic oligonucleotide
atttaggaacaagggcaagc

SEQ ID NO: 519 - DNA, 20 bp, Artificial sequence
  Synthetic oligonucleotide
ttatttaattaccctgctca

SEQ ID NO: 520 - DNA, 20 bp, Artificial sequence
  Synthetic oligonucleotide
tcctccctttaaagggaagg

SEQ ID NO: 521 - DNA, 20 bp, Artificial sequence
  Synthetic oligonucleotide
aaattcctttaaggtgttgc

SEQ ID NO: 522 - DNA, 20 bp, Artificial sequence
  Synthetic oligonucleotide
ccccattgccactacagaga

SEQ ID NO: 523 - DNA, 20 bp, Artificial sequence
  Synthetic oligonucleotide
ctttccagcaaaaccattcg

SEQ ID NO: 524 - DNA, 20 bp, Artificial sequence
  Synthetic oligonucleotide
ccagcccagaaaaactgcaa

SEQ ID NO: 525 - DNA, 20 bp, Artificial sequence
  Synthetic oligonucleotide
tgtttctgtgtgcacatacg

SEQ ID NO: 526 - DNA, 20 bp, Artificial sequence
  Synthetic oligonucleotide
tccagtgcttgtgcatgtgc

SEQ ID NO: 527 - DNA, 20 bp, Artificial sequence
  Synthetic oligonucleotide
ccttcccaaatgcctgcccc

SEQ ID NO: 528 - DNA, 20 bp, Artificial sequence
  Synthetic oligonucleotide
ggtaattttcctcaacaggc

SEQ ID NO: 529 - DNA, 20 bp, Artificial sequence
  Synthetic oligonucleotide
ttatgtgtctcaaatagatg

SEQ ID NO: 530 - DNA, 20 bp, Artificial sequence
  Synthetic oligonucleotide
gggctaccttaacaaagctt

SEQ ID NO: 531 - DNA, 20 bp, Artificial sequence
  Synthetic oligonucleotide
tcttctctgcagagcacaga

SEQ ID NO: 532 - DNA, 20 bp, Artificial sequence
  Synthetic oligonucleotide
tcaccagctcatctctcagg

SEQ ID NO: 533 - DNA, 20 bp, Artificial sequence
  Synthetic oligonucleotide
ctagaatgaagacacccgcc

SEQ ID NO: 534 - DNA, 20 bp, Artificial sequence
  Synthetic oligonucleotide
atccagagagggctcctgga

SEQ ID NO: 535 - DNA, 20 bp, Artificial sequence
  Synthetic oligonucleotide
aagatatccagagagggctc

SEQ ID NO: 536 - DNA, 20 bp, Artificial sequence
  Synthetic oligonucleotide
catagaagatatccagagag

SEQ ID NO: 537 - DNA, 20 bp, Artificial sequence
  Synthetic oligonucleotide
agccgattttgctccgcacc

SEQ ID NO: 538 - DNA, 20 bp, Artificial sequence
  Synthetic oligonucleotide
gcagccgattttgctccgca

SEQ ID NO: 539 - DNA, 20 bp, Artificial sequence
  Synthetic oligonucleotide
cgtcagctggatgccgcagc

SEQ ID NO: 540 - DNA, 20 bp, Artificial sequence
  Synthetic oligonucleotide
gcaggctgtacgccttctcg

SEQ ID NO: 541 - DNA, 20 bp, Artificial sequence
  Synthetic oligonucleotide
ccgctgcaggctgtacgcct

SEQ ID NO: 542 - DNA, 20 bp, Artificial sequence
  Synthetic oligonucleotide
acggctgctgcataaactcg

SEQ ID NO: 543 - DNA, 20 bp, Artificial sequence
  Synthetic oligonucleotide
caaagctgatctgcacggta

SEQ ID NO: 544 - DNA, 20 bp, Artificial sequence
  Synthetic oligonucleotide
cttcacaaagctgatctgca

SEQ ID NO: 545 - DNA, 20 bp, Artificial sequence
  Synthetic oligonucleotide
ggccccagcccttcacaaag

SEQ ID NO: 546 - DNA, 20 bp, Artificial sequence
  Synthetic oligonucleotide
gaagatgacctctagccagc

SEQ ID NO: 547 - DNA, 20 bp, Artificial sequence
  Synthetic oligonucleotide
ctgttgaagatgacctctag

SEQ ID NO: 548 - DNA, 20 bp, Artificial sequence
  Synthetic oligonucleotide
gctaccggctgttgaagatg

SEQ ID NO: 549 - DNA, 20 bp, Artificial sequence
  Synthetic oligonucleotide
ctcagctcacgctctgtccc

SEQ ID NO: 550 - DNA, 20 bp, Artificial sequence
  Synthetic oligonucleotide
gctcagctcacgctctgtcc

SEQ ID NO: 551 - DNA, 20 bp, Artificial sequence
  Synthetic oligonucleotide
tgctcagctcacgctctgtc

SEQ ID NO: 552 - DNA, 20 bp, Artificial sequence
  Synthetic oligonucleotide
agtagtttgaagtgtggcct

SEQ ID NO: 553 - DNA, 20 bp, Artificial sequence
  Synthetic oligonucleotide
agcaaagtagtttgaagtgt

SEQ ID NO: 554 - DNA, 20 bp, Artificial sequence
  Synthetic oligonucleotide
ttagcagcaaagtagtttga

SEQ ID NO: 555 - DNA, 20 bp, Artificial sequence
  Synthetic oligonucleotide
atgaaaagcaagcactcagg

SEQ ID NO: 556 - DNA, 20 bp, Artificial sequence
  Synthetic oligonucleotide
catgaaaagcaagcactcag

SEQ ID NO: 557 - DNA, 20 bp, Artificial sequence
  Synthetic oligonucleotide
gcatgaaaagcaagcactca

SEQ ID NO: 558 - DNA, 20 bp, Artificial sequence
  Synthetic oligonucleotide
aaagagtttgcatgaaaagc

SEQ ID NO: 559 - DNA, 20 bp, Artificial sequence
  Synthetic oligonucleotide
cgaccaaagagtttgcatga

SEQ ID NO: 560 - DNA, 20 bp, Artificial sequence
  Synthetic oligonucleotide
aaaaacgaccaaagagtttg

SEQ ID NO: 561 - DNA, 20 bp, Artificial sequence
  Synthetic oligonucleotide
agcgaaacaaaacagaacac

SEQ ID NO: 562 - DNA, 20 bp, Artificial sequence
  Synthetic oligonucleotide
caaagagcgaaacaaaacag

SEQ ID NO: 563 - DNA, 20 bp, Artificial sequence
  Synthetic oligonucleotide
tttctcaaagagcgaaacaa

SEQ ID NO: 564 - DNA, 20 bp, Artificial sequence
  Synthetic oligonucleotide
aaaacccccaacaattcttt

SEQ ID NO: 565 - DNA, 20 bp, Artificial sequence
  Synthetic oligonucleotide
ccaaaaaaacccccaacaat

SEQ ID NO: 566 - DNA, 20 bp, Artificial sequence
  Synthetic oligonucleotide
tacctgccccttcttccaaa

SEQ ID NO: 567 - DNA, 20 bp, Artificial sequence
  Synthetic oligonucleotide
cttggatttctgcttcccct

SEQ ID NO: 568 - DNA, 20 bp, Artificial sequence
  Synthetic oligonucleotide
tggtgcttggatttctgctt

SEQ ID NO: 569 - DNA, 20 bp, Artificial sequence
  Synthetic oligonucleotide
tttggtggtgcttggatttc

SEQ ID NO: 570 - DNA, 20 bp, Artificial sequence
  Synthetic oligonucleotide
ctgacaagtgaaatgatgac

SEQ ID NO: 571 - DNA, 20 bp, Artificial sequence
  Synthetic oligonucleotide
cactcctgacaagtgaaatg

SEQ ID NO: 572 - DNA, 20 bp, Artificial sequence
  Synthetic oligonucleotide
acacacactcctgacaagtg

SEQ ID NO: 573 - DNA, 20 bp, Artificial sequence
  Synthetic oligonucleotide
ctgcaaacctctctgctggg

SEQ ID NO: 574 - DNA, 20 bp, Artificial sequence
  Synthetic oligonucleotide
ggactgcaaacctctctgct

SEQ ID NO: 575 - DNA, 20 bp, Artificial sequence
  Synthetic oligonucleotide
tgggactgcaaacctctctg

SEQ ID NO: 576 - DNA, 20 bp, Artificial sequence
  Synthetic oligonucleotide
gggcaggagagacaccgctt

SEQ ID NO: 577 - DNA, 20 bp, Artificial sequence
  Synthetic oligonucleotide
tgcctctgccccactgagcg

SEQ ID NO: 578 - DNA, 20 bp, Artificial sequence
  Synthetic oligonucleotide
ctgcctctgccccactgagc

SEQ ID NO: 579 - DNA, 20 bp, Artificial sequence
  Synthetic oligonucleotide
agccgtgctcctggcagctg

SEQ ID NO: 580 - DNA, 20 bp, Artificial sequence
  Synthetic oligonucleotide
gagccgtgctcctggcagct

SEQ ID NO: 581 - DNA, 20 bp, Artificial sequence
  Synthetic oligonucleotide
ccttgatgagggagaggagg

SEQ ID NO: 582 - DNA, 20 bp, Artificial sequence
  Synthetic oligonucleotide
ctgctcagaagcctgtggac

SEQ ID NO: 583 - DNA, 20 bp, Artificial sequence
  Synthetic oligonucleotide
cgctgctcagaagcctgtgg

SEQ ID NO: 584 - DNA, 20 bp, Artificial sequence
  Synthetic oligonucleotide
ggccactagcaggctcgctg

SEQ ID NO: 585 - DNA, 20 bp, Artificial sequence
  Synthetic oligonucleotide
tggccaaaaaagaaagacgc

SEQ ID NO: 586 - DNA, 20 bp, Artificial sequence
  Synthetic oligonucleotide
gatggccaaaaaagaaagac

SEQ ID NO: 587 - DNA, 20 bp, Artificial sequence
  Synthetic oligonucleotide
ggagatccaggagcagatgg

SEQ ID NO: 588 - DNA, 20 bp, Artificial sequence
  Synthetic oligonucleotide
ctgggtgagcaatactgtga

SEQ ID NO: 589 - DNA, 20 bp, Artificial sequence
  Synthetic oligonucleotide
atgtcaccagggcaggcagg

SEQ ID NO: 590 - DNA, 20 bp, Artificial sequence
  Synthetic oligonucleotide
acctgatgtcaccagggcag

SEQ ID NO: 591 - DNA, 20 bp, Artificial sequence
  Synthetic oligonucleotide
tgctgagctggttttctaag

SEQ ID NO: 592 - DNA, 20 bp, Artificial sequence
  Synthetic oligonucleotide
cagtgctgagctggttttct

SEQ ID NO: 593 - DNA, 20 bp, Artificial sequence
  Synthetic oligonucleotide
caggatgggagcaggcagtg

SEQ ID NO: 594 - DNA, 20 bp, Artificial sequence
  Synthetic oligonucleotide
ttaacacacaggatgggagc

SEQ ID NO: 595 - DNA, 20 bp, Artificial sequence
  Synthetic oligonucleotide
gcttaacacacaggatggga

SEQ ID NO: 596 - DNA, 20 bp, Artificial sequence
  Synthetic oligonucleotide
gcagagcttaacacacagga

SEQ ID NO: 597 - DNA, 20 bp, Artificial sequence
  Synthetic oligonucleotide
aatccttcttggagggaagg

SEQ ID NO: 598 - DNA, 20 bp, Artificial sequence
  Synthetic oligonucleotide
gaccaaatccttcttggagg

SEQ ID NO: 599 - DNA, 20 bp, Artificial sequence
  Synthetic oligonucleotide
tgacggaccaaatccttctt

SEQ ID NO: 600 - DNA, 20 bp, Artificial sequence
  Synthetic oligonucleotide
ggtgtcagcctaggatggta

SEQ ID NO: 601 - DNA, 20 bp, Artificial sequence
  Synthetic oligonucleotide
agttaggtgtcagcctagga

SEQ ID NO: 602 - DNA, 20 bp, Artificial sequence
  Synthetic oligonucleotide
agaagagttaggtgtcagcc

SEQ ID NO: 603 - DNA, 20 bp, Artificial sequence
  Synthetic oligonucleotide
catacgagtgtatgagttgt

SEQ ID NO: 604 - DNA, 20 bp, Artificial sequence
  Synthetic oligonucleotide
aagtatcatacgagtgtatg

SEQ ID NO: 605 - DNA, 20 bp, Artificial sequence
  Synthetic oligonucleotide
gaagtatcatacgagtgtat

SEQ ID NO: 606 - DNA, 20 bp, Artificial sequence
  Synthetic oligonucleotide
gttaaagtctaaacatgctc

SEQ ID NO: 607 - DNA, 20 bp, Artificial sequence
  Synthetic oligonucleotide
cttatgttaaagtctaaaca

SEQ ID NO: 608 - DNA, 20 bp, Artificial sequence
  Synthetic oligonucleotide
aatagcttatgttaaagtct

SEQ ID NO: 609 - DNA, 20 bp, Artificial sequence
  Synthetic oligonucleotide
taaatttccaatgagaatgc

SEQ ID NO: 610 - DNA, 20 bp, Artificial sequence
  Synthetic oligonucleotide
aatgctaaatttccaatgag

SEQ ID NO: 611 - DNA, 20 bp, Artificial sequence
  Synthetic oligonucleotide
actacaatgctaaatttcca

SEQ ID NO: 612 - DNA, 20 bp, Artificial sequence
  Synthetic oligonucleotide
ttttttcaggagtcctttct

SEQ ID NO: 613 - DNA, 20 bp, Artificial sequence
  Synthetic oligonucleotide
aggttttttttcaggagtcc

SEQ ID NO: 614 - DNA, 20 bp, Artificial sequence
  Synthetic oligonucleotide
ataaatctcaggtttttttt

SEQ ID NO: 615 - DNA, 20 bp, Artificial sequence
  Synthetic oligonucleotide
atttatattaaagcaaagtg

SEQ ID NO: 616 - DNA, 20 bp, Artificial sequence
  Synthetic oligonucleotide
tttgcatttatattaaagca

SEQ ID NO: 617 - DNA, 20 bp, Artificial sequence
  Synthetic oligonucleotide
tgttatttgcatttatatta

SEQ ID NO: 618 - DNA, 20 bp, Artificial sequence
  Synthetic oligonucleotide
cgtttaatggaacataaact

SEQ ID NO: 619 - DNA, 20 bp, Artificial sequence
  Synthetic oligonucleotide
agtgtacattttaaaaatcg

SEQ ID NO: 620 - DNA, 20 bp, Artificial sequence
  Synthetic oligonucleotide
agactctagttcgcagagtc

SEQ ID NO: 621 - DNA, 20 bp, Artificial sequence
  Synthetic oligonucleotide
tcagttggtttgagaaaatc

SEQ ID NO: 622 - DNA, 20 bp, Artificial sequence
  Synthetic oligonucleotide
gacagtcagttggtttgaga

SEQ ID NO: 623 - DNA, 20 bp, Artificial sequence
  Synthetic oligonucleotide
atctggacagtcagttggtt

SEQ ID NO: 624 - DNA, 20 bp, Artificial sequence
  Synthetic oligonucleotide
acagcatctggacagtcagt

SEQ ID NO: 625 - DNA, 20 bp, Artificial sequence
  Synthetic oligonucleotide
tccagttcggccttccatcc

SEQ ID NO: 626 - DNA, 16 bp, Artificial sequence
  Synthetic oligonucleotide
ccctgcgcggctctcc

SEQ ID NO: 627 - DNA, 16 bp, Artificial sequence
  Synthetic oligonucleotide
ggcccgcgccctgcgc

SEQ ID NO: 628 - DNA, 16 bp, Artificial sequence
  Synthetic oligonucleotide
cgcggcccgcgccctg

SEQ ID NO: 629 - DNA, 16 bp, Artificial sequence
  Synthetic oligonucleotide
ccgcgcggcccgcgcc

SEQ ID NO: 630 - DNA, 16 bp, Artificial sequence
  Synthetic oligonucleotide
accccgcgcggcccgc

SEQ ID NO: 631 - DNA, 16 bp, Artificial sequence
  Synthetic oligonucleotide
cccaccccgcgcggcc

SEQ ID NO: 632 - DNA, 16 bp, Artificial sequence
  Synthetic oligonucleotide
tgccccaccccgcgcg

SEQ ID NO: 633 - DNA, 16 bp, Artificial sequence
  Synthetic oligonucleotide
ggctgccccaccccgc

SEQ ID NO: 634 - DNA, 16 bp, Artificial sequence
  Synthetic oligonucleotide
gctccggctgccccac

SEQ ID NO: 635 - DNA, 16 bp, Artificial sequence
  Synthetic oligonucleotide
tgcgctccggctgccc

SEQ ID NO: 636 - DNA, 16 bp, Artificial sequence
  Synthetic oligonucleotide
ggcaggagcggcggcg

SEQ ID NO: 637 - DNA, 16 bp, Artificial sequence
  Synthetic oligonucleotide
ccgggcaggagcggcg

SEQ ID NO: 638 - DNA, 16 bp, Artificial sequence
  Synthetic oligonucleotide
ggcccgggcaggagcg

SEQ ID NO: 639 - DNA, 16 bp, Artificial sequence
  Synthetic oligonucleotide
caggcgacagcagcag

SEQ ID NO: 640 - DNA, 16 bp, Artificial sequence
  Synthetic oligonucleotide
gcgcaggcgacagcag

SEQ ID NO: 641 - DNA, 16 bp, Artificial sequence
  Synthetic oligonucleotide
caggcgcaggcgacag

SEQ ID NO: 642 - DNA, 16 bp, Artificial sequence
  Synthetic oligonucleotide
cagcaggcgcaggcga

SEQ ID NO: 643 - DNA, 16 bp, Artificial sequence
  Synthetic oligonucleotide
tgaagaagtcgggcgc

SEQ ID NO: 644 - DNA, 16 bp, Artificial sequence
  Synthetic oligonucleotide
ccatgaagaagtcggg

SEQ ID NO: 645 - DNA, 16 bp, Artificial sequence
  Synthetic oligonucleotide
acaccatgaagaagtc

SEQ ID NO: 646 - DNA, 16 bp, Artificial sequence
  Synthetic oligonucleotide
gcgaggagaaaagtcg

SEQ ID NO: 647 - DNA, 16 bp, Artificial sequence
  Synthetic oligonucleotide
gaggcgaggagaaaag

SEQ ID NO: 648 - DNA, 16 bp, Artificial sequence
  Synthetic oligonucleotide
gaggaggcgaggagaa

SEQ ID NO: 649 - DNA, 16 bp, Artificial sequence
  Synthetic oligonucleotide
ggcgaggaggcgagga

SEQ ID NO: 650 - DNA, 16 bp, Artificial sequence
  Synthetic oligonucleotide
gtcctgaacatgcggg

SEQ ID NO: 651 - DNA, 16 bp, Artificial sequence
  Synthetic oligonucleotide
ggacgagcgcagatcg

SEQ ID NO: 652 - DNA, 16 bp, Artificial sequence
  Synthetic oligonucleotide
gccggacgagcgcaga

SEQ ID NO: 653 - DNA, 16 bp, Artificial sequence
  Synthetic oligonucleotide
ggctcctccagagacg

SEQ ID NO: 654 - DNA, 16 bp, Artificial sequence
  Synthetic oligonucleotide
cgcacggctcctccag

SEQ ID NO: 655 - DNA, 16 bp, Artificial sequence
  Synthetic oligonucleotide
gggcgcacggctcctc

SEQ ID NO: 656 - DNA, 16 bp, Artificial sequence
  Synthetic oligonucleotide
gtccgtcgccccttct

SEQ ID NO: 657 - DNA, 16 bp, Artificial sequence
  Synthetic oligonucleotide
ctgtccgtcgcccctt

SEQ ID NO: 658 - DNA, 16 bp, Artificial sequence
  Synthetic oligonucleotide
ggctgtccgtcgcccc

SEQ ID NO: 659 - DNA, 16 bp, Artificial sequence
  Synthetic oligonucleotide
cggctgtccgtcgccc

SEQ ID NO: 660 - DNA, 16 bp, Artificial sequence
  Synthetic oligonucleotide
gctcggctgtccgtcg

SEQ ID NO: 661 - DNA, 16 bp, Artificial sequence
  Synthetic oligonucleotide
cgctcggctgtccgtc

SEQ ID NO: 662 - DNA, 16 bp, Artificial sequence
  Synthetic oligonucleotide
tgcgctcggctgtccg

SEQ ID NO: 663 - DNA, 16 bp, Artificial sequence
  Synthetic oligonucleotide
ccccatgcgctcggct

SEQ ID NO: 664 - DNA, 16 bp, Artificial sequence
  Synthetic oligonucleotide
cggccccatgcgctcg

SEQ ID NO: 665 - DNA, 16 bp, Artificial sequence
  Synthetic oligonucleotide
gccaccggccccatgc

SEQ ID NO: 666 - DNA, 16 bp, Artificial sequence
  Synthetic oligonucleotide
cgccttgcccaggcag

SEQ ID NO: 667 - DNA, 16 bp, Artificial sequence
  Synthetic oligonucleotide
caccgccttgcccagg

SEQ ID NO: 668 - DNA, 16 bp, Artificial sequence
  Synthetic oligonucleotide
tcgcaccgccttgccc

SEQ ID NO: 669 - DNA, 16 bp, Artificial sequence
  Synthetic oligonucleotide
cacctcgcaccgcctt

SEQ ID NO: 670 - DNA, 16 bp, Artificial sequence
  Synthetic oligonucleotide
tggcacctcgcaccgc

SEQ ID NO: 671 - DNA, 16 bp, Artificial sequence
  Synthetic oligonucleotide
ctttggcacctcgcac

SEQ ID NO: 672 - DNA, 16 bp, Artificial sequence
  Synthetic oligonucleotide
gacctttggcacctcg

SEQ ID NO: 673 - DNA, 16 bp, Artificial sequence
  Synthetic oligonucleotide
ggtgacctttggcacc

SEQ ID NO: 674 - DNA, 16 bp, Artificial sequence
  Synthetic oligonucleotide
ggtggtgacctttggc

SEQ ID NO: 675 - DNA, 16 bp, Artificial sequence
  Synthetic oligonucleotide
ggatggtggtgacctt

SEQ ID NO: 676 - DNA, 16 bp, Artificial sequence
  Synthetic oligonucleotide
ctccttcagtttcttg

SEQ ID NO: 677 - DNA, 16 bp, Artificial sequence
  Synthetic oligonucleotide
tgccgctccttcagtt

SEQ ID NO: 678 - DNA, 16 bp, Artificial sequence
  Synthetic oligonucleotide
agctgccgctccttca

SEQ ID NO: 679 - DNA, 16 bp, Artificial sequence
  Synthetic oligonucleotide
gcagctccagctgccg

SEQ ID NO: 680 - DNA, 16 bp, Artificial sequence
  Synthetic oligonucleotide
tggagcagcagctcca

SEQ ID NO: 681 - DNA, 16 bp, Artificial sequence
  Synthetic oligonucleotide
cggcctggagcagcag

SEQ ID NO: 682 - DNA, 16 bp, Artificial sequence
  Synthetic oligonucleotide
ctccacggcctggagc

SEQ ID NO: 683 - DNA, 16 bp, Artificial sequence
  Synthetic oligonucleotide
ggactccacggcctgg

SEQ ID NO: 684 - DNA, 16 bp, Artificial sequence
  Synthetic oligonucleotide
aggcacgcggtgcgcg

SEQ ID NO: 685 - DNA, 16 bp, Artificial sequence
  Synthetic oligonucleotide
aggaggcacgcggtgc

SEQ ID NO: 686 - DNA, 16 bp, Artificial sequence
  Synthetic oligonucleotide
gctgcgcaggctgcgc

SEQ ID NO: 687 - DNA, 16 bp, Artificial sequence
  Synthetic oligonucleotide
ggcggctgcgcaggct

SEQ ID NO: 688 - DNA, 16 bp, Artificial sequence
  Synthetic oligonucleotide
gagggcggctgcgcag

SEQ ID NO: 689 - DNA, 16 bp, Artificial sequence
  Synthetic oligonucleotide
gacgagggcggctgcg

SEQ ID NO: 690 - DNA, 16 bp, Artificial sequence
  Synthetic oligonucleotide
taggacgagggcggct

SEQ ID NO: 691 - DNA, 16 bp, Artificial sequence
  Synthetic oligonucleotide
gagtaggacgagggcg

SEQ ID NO: 692 - DNA, 16 bp, Artificial sequence
  Synthetic oligonucleotide
agcgagtaggacgagg

SEQ ID NO: 693 - DNA, 16 bp, Artificial sequence
  Synthetic oligonucleotide
ttgcacagcaggaggg

SEQ ID NO: 694 - DNA, 16 bp, Artificial sequence
  Synthetic oligonucleotide
actttgcacagcagga

SEQ ID NO: 695 - DNA, 16 bp, Artificial sequence
  Synthetic oligonucleotide
aacactttgcacagca

SEQ ID NO: 696 - DNA, 16 bp, Artificial sequence
  Synthetic oligonucleotide
tgacttccgaggaatg

SEQ ID NO: 697 - DNA, 16 bp, Artificial sequence
  Synthetic oligonucleotide
ttgacttccgaggaat

SEQ ID NO: 698 - DNA, 16 bp, Artificial sequence
  Synthetic oligonucleotide
ctcttgacttccgagg

SEQ ID NO: 699 - DNA, 16 bp, Artificial sequence
  Synthetic oligonucleotide
cctcttgacttccgag

SEQ ID NO: 700 - DNA, 16 bp, Artificial sequence
  Synthetic oligonucleotide
agcctcttgacttccg

SEQ ID NO: 701 - DNA, 16 bp, Artificial sequence
  Synthetic oligonucleotide
acacagcctcttgact

SEQ ID NO: 702 - DNA, 16 bp, Artificial sequence
  Synthetic oligonucleotide
gcaacacagcctcttg

SEQ ID NO: 703 - DNA, 16 bp, Artificial sequence
  Synthetic oligonucleotide
cacagcaacacagcct

SEQ ID NO: 704 - DNA, 16 bp, Artificial sequence
  Synthetic oligonucleotide
attcacagcaacacag

SEQ ID NO: 705 - DNA, 16 bp, Artificial sequence
  Synthetic oligonucleotide
aagattcacagcaaca

SEQ ID NO: 706 - DNA, 16 bp, Artificial sequence
  Synthetic oligonucleotide
ctagttcgcagagtcg

SEQ ID NO: 707 - DNA, 16 bp, Artificial sequence
  Synthetic oligonucleotide
ggagggtatgcacact

SEQ ID NO: 708 - DNA, 16 bp, Artificial sequence
  Synthetic oligonucleotide
ccaggagggtatgcac

SEQ ID NO: 709 - DNA, 16 bp, Artificial sequence
  Synthetic oligonucleotide
tcccaggagggtatgc

SEQ ID NO: 710 - DNA, 16 bp, Artificial sequence
  Synthetic oligonucleotide
tctcccaggagggtat

SEQ ID NO: 711 - DNA, 16 bp, Artificial sequence
  Synthetic oligonucleotide
acactctcccaggagg

SEQ ID NO: 712 - DNA, 16 bp, Artificial sequence
  Synthetic oligonucleotide
gcacactctcccagga

SEQ ID NO: 713 - DNA, 16 bp, Artificial sequence
  Synthetic oligonucleotide
ttatagcacgcctctc

SEQ ID NO: 714 - DNA, 16 bp, Artificial sequence
  Synthetic oligonucleotide
cgtgattctccgtatt

SEQ ID NO: 715 - DNA, 16 bp, Artificial sequence
  Synthetic oligonucleotide
ccactggtgttcgacg

SEQ ID NO: 716 - DNA, 16 bp, Artificial sequence
  Synthetic oligonucleotide
gggccactggtgttcg

SEQ ID NO: 717 - DNA, 16 bp, Artificial sequence
  Synthetic oligonucleotide
gtatctgggccactgg

SEQ ID NO: 718 - DNA, 16 bp, Artificial sequence
  Synthetic oligonucleotide
acagtatctgggccac

SEQ ID NO: 719 - DNA, 16 bp, Artificial sequence
  Synthetic oligonucleotide
acgacagtatctgggc

SEQ ID NO: 720 - DNA, 16 bp, Artificial sequence
  Synthetic oligonucleotide
gccacgacagtatctg

SEQ ID NO: 721 - DNA, 16 bp, Artificial sequence
  Synthetic oligonucleotide
gcggccacgacagtat

SEQ ID NO: 722 - DNA, 16 bp, Artificial sequence
  Synthetic oligonucleotide
tgcgcggccacgacag

SEQ ID NO: 723 - DNA, 16 bp, Artificial sequence
  Synthetic oligonucleotide
aggtgcgcggccacga

SEQ ID NO: 724 - DNA, 16 bp, Artificial sequence
  Synthetic oligonucleotide
ctctttgccccaaaac

SEQ ID NO: 725 - DNA, 16 bp, Artificial sequence
  Synthetic oligonucleotide
tccaactctctttgcc

SEQ ID NO: 726 - DNA, 16 bp, Artificial sequence
  Synthetic oligonucleotide
ccatccaactctcttt

SEQ ID NO: 727 - DNA, 16 bp, Artificial sequence
  Synthetic oligonucleotide
cttccatccaactctc

SEQ ID NO: 728 - DNA, 16 bp, Artificial sequence
  Synthetic oligonucleotide
ggccttccatccaact

SEQ ID NO: 729 - DNA, 16 bp, Artificial sequence
  Synthetic oligonucleotide
gttcggccttccatcc

SEQ ID NO: 730 - DNA, 16 bp, Artificial sequence
  Synthetic oligonucleotide
gatacccagttcggcc

SEQ ID NO: 731 - DNA, 16 bp, Artificial sequence
  Synthetic oligonucleotide
agatacccagttcggc

SEQ ID NO: 732 - DNA, 16 bp, Artificial sequence
  Synthetic oligonucleotide
gaaggaaaaagtaggg

SEQ ID NO: 733 - DNA, 16 bp, Artificial sequence
  Synthetic oligonucleotide
cttatctgtgcggaag

SEQ ID NO: 734 - DNA, 16 bp, Artificial sequence
  Synthetic oligonucleotide
actaatctacagactt

SEQ ID NO: 735 - DNA, 16 bp, Artificial sequence
  Synthetic oligonucleotide
cccactaatctacaga

SEQ ID NO: 736 - DNA, 16 bp, Artificial sequence
  Synthetic oligonucleotide
cgagaagcccaggccc

SEQ ID NO: 737 - DNA, 16 bp, Artificial sequence
  Synthetic oligonucleotide
tctcagccgagaagcc

SEQ ID NO: 738 - DNA, 16 bp, Artificial sequence
  Synthetic oligonucleotide
aaggagtttcagggtc

SEQ ID NO: 739 - DNA, 16 bp, Artificial sequence
  Synthetic oligonucleotide
tctggagtaaggaggg

SEQ ID NO: 740 - DNA, 16 bp, Artificial sequence
  Synthetic oligonucleotide
gtatctggagtaagga

SEQ ID NO: 741 - DNA, 16 bp, Artificial sequence
  Synthetic oligonucleotide
cgggtatctggagtaa

SEQ ID NO: 742 - DNA, 16 bp, Artificial sequence
  Synthetic oligonucleotide
catcgggtatctggag

SEQ ID NO: 743 - DNA, 16 bp, Artificial sequence
  Synthetic oligonucleotide
agcacaaatacatgaa

SEQ ID NO: 744 - DNA, 16 bp, Artificial sequence
  Synthetic oligonucleotide
tgttaaagctgagccc

SEQ ID NO: 745 - DNA, 16 bp, Artificial sequence
  Synthetic oligonucleotide
cgtgttaaagctgagc

SEQ ID NO: 746 - DNA, 16 bp, Artificial sequence
  Synthetic oligonucleotide
ccaagacacttctctc

SEQ ID NO: 747 - DNA, 16 bp, Artificial sequence
  Synthetic oligonucleotide
gtcctatttggttccc

SEQ ID NO: 748 - DNA, 16 bp, Artificial sequence
  Synthetic oligonucleotide
catcaaccagtcctat

SEQ ID NO: 749 - DNA, 16 bp, Artificial sequence
  Synthetic oligonucleotide
gagttatccccatcaa

SEQ ID NO: 750 - DNA, 16 bp, Artificial sequence
  Synthetic oligonucleotide
tccgagttatccccat

SEQ ID NO: 751 - DNA, 16 bp, Artificial sequence
  Synthetic oligonucleotide
ctccgagttatcccca

SEQ ID NO: 752 - DNA, 16 bp, Artificial sequence
  Synthetic oligonucleotide
tctccgagttatcccc

SEQ ID NO: 753 - DNA, 16 bp, Artificial sequence
  Synthetic oligonucleotide
ttgcaggtgactggag

SEQ ID NO: 754 - DNA, 16 bp, Artificial sequence
  Synthetic oligonucleotide
gaatactgagaaaacc

SEQ ID NO: 755 - DNA, 16 bp, Artificial sequence
  Synthetic oligonucleotide
tttgatagtccctatg

SEQ ID NO: 756 - DNA, 16 bp, Artificial sequence
  Synthetic oligonucleotide
ctcctactgtaagagg

SEQ ID NO: 757 - DNA, 16 bp, Artificial sequence
  Synthetic oligonucleotide
aacagatctatctcct

SEQ ID NO: 758 - DNA, 16 bp, Artificial sequence
  Synthetic oligonucleotide
acttttagcaaacaga

SEQ ID NO: 759 - DNA, 16 bp, Artificial sequence
  Synthetic oligonucleotide
cacaaaaaccaaggtt

SEQ ID NO: 760 - DNA, 16 bp, Artificial sequence
  Synthetic oligonucleotide
ggcacaaaaaccaagg

SEQ ID NO: 761 - DNA, 16 bp, Artificial sequence
  Synthetic oligonucleotide
tgcccaacccttcact

SEQ ID NO: 762 - DNA, 16 bp, Artificial sequence
  Synthetic oligonucleotide
aggagctaaatggtgc

SEQ ID NO: 763 - DNA, 16 bp, Artificial sequence
  Synthetic oligonucleotide
aaaacagagcttggta

SEQ ID NO: 764 - DNA, 16 bp, Artificial sequence
  Synthetic oligonucleotide
cttggaaaatgaactt

SEQ ID NO: 765 - DNA, 16 bp, Artificial sequence
  Synthetic oligonucleotide
tccaaatttgaagaat

SEQ ID NO: 766 - DNA, 16 bp, Artificial sequence
  Synthetic oligonucleotide
ggaaaacctccaaatt

SEQ ID NO: 767 - DNA, 16 bp, Artificial sequence
  Synthetic oligonucleotide
tcttttaaggaaaacc

SEQ ID NO: 768 - DNA, 16 bp, Artificial sequence
  Synthetic oligonucleotide
ggtcactgttctctct

SEQ ID NO: 769 - DNA, 16 bp, Artificial sequence
  Synthetic oligonucleotide
gctaaggtcactgttc

SEQ ID NO: 770 - DNA, 16 bp, Artificial sequence
  Synthetic oligonucleotide
ggaacatttacccctg

SEQ ID NO: 771 - DNA, 16 bp, Artificial sequence
  Synthetic oligonucleotide
ctgggaacatttaccc

SEQ ID NO: 772 - DNA, 16 bp, Artificial sequence
  Synthetic oligonucleotide
gggaacatggcctttc

SEQ ID NO: 773 - DNA, 16 bp, Artificial sequence
  Synthetic oligonucleotide
aagacctgggtcagcg

SEQ ID NO: 774 - DNA, 16 bp, Artificial sequence
  Synthetic oligonucleotide
ggccaaacattctccc

SEQ ID NO: 775 - DNA, 16 bp, Artificial sequence
  Synthetic oligonucleotide
gtaaatggtccatgta

SEQ ID NO: 776 - DNA, 16 bp, Artificial sequence
  Synthetic oligonucleotide
aaaaattcaacctaag

SEQ ID NO: 777 - DNA, 16 bp, Artificial sequence
  Synthetic oligonucleotide
caagaccaaaaattca

SEQ ID NO: 778 - DNA, 16 bp, Artificial sequence
  Synthetic oligonucleotide
aacccaagaccaaaaa

SEQ ID NO: 779 - DNA, 16 bp, Artificial sequence
  Synthetic oligonucleotide
gattttaacagttgtc

SEQ ID NO: 780 - DNA, 16 bp, Artificial sequence
  Synthetic oligonucleotide
taccaggccccagccc

SEQ ID NO: 781 - DNA, 16 bp, Artificial sequence
  Synthetic oligonucleotide
ctccaaaggctgcagg

SEQ ID NO: 782 - DNA, 16 bp, Artificial sequence
  Synthetic oligonucleotide
attatagcaaaatgga

SEQ ID NO: 783 - DNA, 16 bp, Artificial sequence
  Synthetic oligonucleotide
acagccacaagtcaca

SEQ ID NO: 784 - DNA, 16 bp, Artificial sequence
  Synthetic oligonucleotide
agccattcctcaaacc

SEQ ID NO: 785 - DNA, 16 bp, Artificial sequence
  Synthetic oligonucleotide
ccagatctcaggtcaa

SEQ ID NO: 786 - DNA, 16 bp, Artificial sequence
  Synthetic oligonucleotide
aagagagaaacgcagt

SEQ ID NO: 787 - DNA, 16 bp, Artificial sequence
  Synthetic oligonucleotide
aagagggacctcggtt

SEQ ID NO: 788 - DNA, 16 bp, Artificial sequence
  Synthetic oligonucleotide
tagaaaagttaagagg

SEQ ID NO: 789 - DNA, 16 bp, Artificial sequence
  Synthetic oligonucleotide
ctagaaaagttaagag

SEQ ID NO: 790 - DNA, 16 bp, Artificial sequence
  Synthetic oligonucleotide
gattttaaaagaggcc

SEQ ID NO: 791 - DNA, 16 bp, Artificial sequence
  Synthetic oligonucleotide
tcatgctgattttaaa

SEQ ID NO: 792 - DNA, 16 bp, Artificial sequence
  Synthetic oligonucleotide
catcatgctgatttta

SEQ ID NO: 793 - DNA, 16 bp, Artificial sequence
  Synthetic oligonucleotide
cctaatctctttcatc

SEQ ID NO: 794 - DNA, 16 bp, Artificial sequence
  Synthetic oligonucleotide
tcctaagtactgttaa

SEQ ID NO: 795 - DNA, 16 bp, Artificial sequence
  Synthetic oligonucleotide
cacgatagtctcagca

SEQ ID NO: 796 - DNA, 16 bp, Artificial sequence
  Synthetic oligonucleotide
ttgaaaacccaaccct

SEQ ID NO: 797 - DNA, 16 bp, Artificial sequence
  Synthetic oligonucleotide
acagagtctttgaaaa

SEQ ID NO: 798 - DNA, 16 bp, Artificial sequence
  Synthetic oligonucleotide
caacagagtctttgaa

SEQ ID NO: 799 - DNA, 16 bp, Artificial sequence
  Synthetic oligonucleotide
ctgcgagagaaaaaga

SEQ ID NO: 800 - DNA, 16 bp, Artificial sequence
  Synthetic oligonucleotide
aagcactaggttctgc

SEQ ID NO: 801 - DNA, 16 bp, Artificial sequence
  Synthetic oligonucleotide
tggtaagcactaggtt

SEQ ID NO: 802 - DNA, 16 bp, Artificial sequence
  Synthetic oligonucleotide
aagcacttggtaagca

SEQ ID NO: 803 - DNA, 16 bp, Artificial sequence
  Synthetic oligonucleotide
agctctaggccactcc

SEQ ID NO: 804 - DNA, 16 bp, Artificial sequence
  Synthetic oligonucleotide
gctcaaagggccaccc

SEQ ID NO: 805 - DNA, 16 bp, Artificial sequence
  Synthetic oligonucleotide
gttccataggcagcca

SEQ ID NO: 806 - DNA, 16 bp, Artificial sequence
  Synthetic oligonucleotide
ccctaccacccctgtg

SEQ ID NO: 807 - DNA, 16 bp, Artificial sequence
  Synthetic oligonucleotide
tgcccttctgcagtgg

SEQ ID NO: 808 - DNA, 16 bp, Artificial sequence
  Synthetic oligonucleotide
tgaaatggtgctctgc

SEQ ID NO: 809 - DNA, 16 bp, Artificial sequence
  Synthetic oligonucleotide
cacacaggcaaccaca

SEQ ID NO: 810 - DNA, 16 bp, Artificial sequence
  Synthetic oligonucleotide
ctccacacaggcaacc

SEQ ID NO: 811 - DNA, 16 bp, Artificial sequence
  Synthetic oligonucleotide
gaaaagccgggcatct

SEQ ID NO: 812 - DNA, 16 bp, Artificial sequence
  Synthetic oligonucleotide
caaaggaaaagccggg

SEQ ID NO: 813 - DNA, 16 bp, Artificial sequence
  Synthetic oligonucleotide
cgccacctttggctgg

SEQ ID NO: 814 - DNA, 16 bp, Artificial sequence
  Synthetic oligonucleotide
ctaacaggaatataca

SEQ ID NO: 815 - DNA, 16 bp, Artificial sequence
  Synthetic oligonucleotide
gggtgaggtggctgcg

SEQ ID NO: 816 - DNA, 16 bp, Artificial sequence
  Synthetic oligonucleotide
aagaactctcctaagc

SEQ ID NO: 817 - DNA, 16 bp, Artificial sequence
  Synthetic oligonucleotide
tcaagaactctcctaa

SEQ ID NO: 818 - DNA, 16 bp, Artificial sequence
  Synthetic oligonucleotide
tcctttagtggcctac

SEQ ID NO: 819 - DNA, 16 bp, Artificial sequence
  Synthetic oligonucleotide
gagcagacgggcaagt

SEQ ID NO: 820 - DNA, 16 bp, Artificial sequence
  Synthetic oligonucleotide
aaaagagcagacgggc

SEQ ID NO: 821 - DNA, 16 bp, Artificial sequence
  Synthetic oligonucleotide
caaataggaaagccaa

SEQ ID NO: 822 - DNA, 16 bp, Artificial sequence
  Synthetic oligonucleotide
ggccaccaggacaatg

SEQ ID NO: 823 - DNA, 16 bp, Artificial sequence
  Synthetic oligonucleotide
aggaaaggtgctgccc

SEQ ID NO: 824 - DNA, 16 bp, Artificial sequence
  Synthetic oligonucleotide
ccccagacctgctaag

SEQ ID NO: 825 - DNA, 16 bp, Artificial sequence
  Synthetic oligonucleotide
gggaaatgttctacct

SEQ ID NO: 826 - DNA, 16 bp, Artificial sequence
  Synthetic oligonucleotide
caccagatcaagacag

SEQ ID NO: 827 - DNA, 16 bp, Artificial sequence
  Synthetic oligonucleotide
cttaagtagagcaaag

SEQ ID NO: 828 - DNA, 16 bp, Artificial sequence
  Synthetic oligonucleotide
acttaagtagagcaaa

SEQ ID NO: 829 - DNA, 16 bp, Artificial sequence
  Synthetic oligonucleotide
aacttaagtagagcaa

SEQ ID NO: 830 - DNA, 16 bp, Artificial sequence
  Synthetic oligonucleotide
gattgatgttgggctg

SEQ ID NO: 831 - DNA, 16 bp, Artificial sequence
  Synthetic oligonucleotide
taaagacaggtttccc

SEQ ID NO: 832 - DNA, 16 bp, Artificial sequence
  Synthetic oligonucleotide
tttaaagacaggtttc

SEQ ID NO: 833 - DNA, 16 bp, Artificial sequence
  Synthetic oligonucleotide
ggcagaaggctctctc

SEQ ID NO: 834 - DNA, 16 bp, Artificial sequence
  Synthetic oligonucleotide
agtcaggctcaatgag

SEQ ID NO: 835 - DNA, 16 bp, Artificial sequence
  Synthetic oligonucleotide
ctcgagtcaggctcaa

SEQ ID NO: 836 - DNA, 16 bp, Artificial sequence
  Synthetic oligonucleotide
agcaccttgtcacccg

SEQ ID NO: 837 - DNA, 16 bp, Artificial sequence
  Synthetic oligonucleotide
cacagcaccttgtcac

SEQ ID NO: 838 - DNA, 16 bp, Artificial sequence
  Synthetic oligonucleotide
gaccacagcaccttgt

SEQ ID NO: 839 - DNA, 16 bp, Artificial sequence
  Synthetic oligonucleotide
acagaccacagcacct

SEQ ID NO: 840 - DNA, 16 bp, Artificial sequence
  Synthetic oligonucleotide
aagacagaccacagca

SEQ ID NO: 841 - DNA, 16 bp, Artificial sequence
  Synthetic oligonucleotide
cgtaagacagaccaca

SEQ ID NO: 842 - DNA, 16 bp, Artificial sequence
  Synthetic oligonucleotide
ggcttcactgcccatc

SEQ ID NO: 843 - DNA, 16 bp, Artificial sequence
  Synthetic oligonucleotide
gctcaggcttcactgc

SEQ ID NO: 844 - DNA, 16 bp, Artificial sequence
  Synthetic oligonucleotide
tctgctcaggcttcac

SEQ ID NO: 845 - DNA, 16 bp, Artificial sequence
  Synthetic oligonucleotide
taatggtctgctcagg

SEQ ID NO: 846 - DNA, 16 bp, Artificial sequence
  Synthetic oligonucleotide
attccaaaaggctgac

SEQ ID NO: 847 - DNA, 16 bp, Artificial sequence
  Synthetic oligonucleotide
cacattccaaaaggct

SEQ ID NO: 848 - DNA, 16 bp, Artificial sequence
  Synthetic oligonucleotide
ccacacattccaaaag

SEQ ID NO: 849 - DNA, 16 bp, Artificial sequence
  Synthetic oligonucleotide
aaaccacacattccaa

SEQ ID NO: 850 - DNA, 16 bp, Artificial sequence
  Synthetic oligonucleotide
gacaaaccacacattc

SEQ ID NO: 851 - DNA, 16 bp, Artificial sequence
  Synthetic oligonucleotide
gaaagacaaaccacac

SEQ ID NO: 852 - DNA, 16 bp, Artificial sequence
  Synthetic oligonucleotide
catgaaagacaaacca

SEQ ID NO: 853 - DNA, 16 bp, Artificial sequence
  Synthetic oligonucleotide
aaacagcatgaaagac

SEQ ID NO: 854 - DNA, 16 bp, Artificial sequence
  Synthetic oligonucleotide
tctaaacagcatgaaa

SEQ ID NO: 855 - DNA, 16 bp, Artificial sequence
  Synthetic oligonucleotide
cgctctaaacagcatg

SEQ ID NO: 856 - DNA, 16 bp, Artificial sequence
  Synthetic oligonucleotide
tgctgtggatttgaaa

SEQ ID NO: 857 - DNA, 16 bp, Artificial sequence
  Synthetic oligonucleotide
gtctgctgtggatttg

SEQ ID NO: 858 - DNA, 16 bp, Artificial sequence
  Synthetic oligonucleotide
ggacagtctgctgtgg

SEQ ID NO: 859 - DNA, 16 bp, Artificial sequence
  Synthetic oligonucleotide
atctggacagtctgct

SEQ ID NO: 860 - DNA, 16 bp, Artificial sequence
  Synthetic oligonucleotide
tgaaagccccccaggg

SEQ ID NO: 861 - DNA, 16 bp, Artificial sequence
  Synthetic oligonucleotide
gagaatgaagtccaga

SEQ ID NO: 862 - DNA, 16 bp, Artificial sequence
  Synthetic oligonucleotide
aacttaaggcatataa

SEQ ID NO: 863 - DNA, 16 bp, Artificial sequence
  Synthetic oligonucleotide
accgatgcatccaact

SEQ ID NO: 864 - DNA, 16 bp, Artificial sequence
  Synthetic oligonucleotide
gggcaccacaatgtca

SEQ ID NO: 865 - DNA, 16 bp, Artificial sequence
  Synthetic oligonucleotide
tgcaggatgaggagct

SEQ ID NO: 866 - DNA, 16 bp, Artificial sequence
  Synthetic oligonucleotide
cccgtccacggaacgg

SEQ ID NO: 867 - DNA, 16 bp, Artificial sequence
  Synthetic oligonucleotide
agctgaagccccccaa

SEQ ID NO: 868 - DNA, 16 bp, Artificial sequence
  Synthetic oligonucleotide
ttaatgacaccaaagt

SEQ ID NO: 869 - DNA, 16 bp, Artificial sequence
  Synthetic oligonucleotide
gttaatgacaccaaag

SEQ ID NO: 870 - DNA, 16 bp, Artificial sequence
  Synthetic oligonucleotide
tcaaatgcatgagtta

SEQ ID NO: 871 - DNA, 16 bp, Artificial sequence
  Synthetic oligonucleotide
tacctgtgagccctga

SEQ ID NO: 872 - DNA, 16 bp, Artificial sequence
  Synthetic oligonucleotide
taccccgtgcctgtca

SEQ ID NO: 873 - DNA, 16 bp, Artificial sequence
  Synthetic oligonucleotide
acaacaatgctctggc

SEQ ID NO: 874 - DNA, 16 bp, Artificial sequence
  Synthetic oligonucleotide
agccagttcttagaaa

SEQ ID NO: 875 - DNA, 16 bp, Artificial sequence
  Synthetic oligonucleotide
cttctattcgagctgc

SEQ ID NO: 876 - DNA, 16 bp, Artificial sequence
  Synthetic oligonucleotide
agcttctattcgagct

SEQ ID NO: 877 - DNA, 16 bp, Artificial sequence
  Synthetic oligonucleotide
ggcacagcttctattc

SEQ ID NO: 878 - DNA, 16 bp, Artificial sequence
  Synthetic oligonucleotide
ggaatgaactttgcct

SEQ ID NO: 879 - DNA, 16 bp, Artificial sequence
  Synthetic oligonucleotide
gaagaggagagccggg

SEQ ID NO: 880 - DNA, 16 bp, Artificial sequence
  Synthetic oligonucleotide
aaaacaaacaagggtc

SEQ ID NO: 881 - DNA, 16 bp, Artificial sequence
  Synthetic oligonucleotide
cattcagggtttaaaa

SEQ ID NO: 882 - DNA, 16 bp, Artificial sequence
  Synthetic oligonucleotide
cacattcagggtttaa

SEQ ID NO: 883 - DNA, 16 bp, Artificial sequence
  Synthetic oligonucleotide
gaaaggaccctttcaa

SEQ ID NO: 884 - DNA, 16 bp, Artificial sequence
  Synthetic oligonucleotide
ttccgaaaggaccctt

SEQ ID NO: 885 - DNA, 16 bp, Artificial sequence
  Synthetic oligonucleotide
accttccgaaaggacc

SEQ ID NO: 886 - DNA, 16 bp, Artificial sequence
  Synthetic oligonucleotide
aaccttccgaaaggac

SEQ ID NO: 887 - DNA, 16 bp, Artificial sequence
  Synthetic oligonucleotide
aaaccttccgaaagga

SEQ ID NO: 888 - DNA, 16 bp, Artificial sequence
  Synthetic oligonucleotide
caaaccttccgaaagg

SEQ ID NO: 889 - DNA, 16 bp, Artificial sequence
  Synthetic oligonucleotide
acaaaccttccgaaag

SEQ ID NO: 890 - DNA, 16 bp, Artificial sequence
  Synthetic oligonucleotide
gacaaaccttccgaaa

SEQ ID NO: 891 - DNA, 16 bp, Artificial sequence
  Synthetic oligonucleotide
gaaggagctcaaactt

SEQ ID NO: 892 - DNA, 16 bp, Artificial sequence
  Synthetic oligonucleotide
tgaacggaaagaagaa

SEQ ID NO: 893 - DNA, 16 bp, Artificial sequence
  Synthetic oligonucleotide
ctctgaacggaaagaa

SEQ ID NO: 894 - DNA, 16 bp, Artificial sequence
  Synthetic oligonucleotide
actctgaacggaaaga

SEQ ID NO: 895 - DNA, 16 bp, Artificial sequence
  Synthetic oligonucleotide
aactctgaacggaaag

SEQ ID NO: 896 - DNA, 16 bp, Artificial sequence
  Synthetic oligonucleotide
caactctgaacggaaa

SEQ ID NO: 897 - DNA, 16 bp, Artificial sequence
  Synthetic oligonucleotide
ccaactctgaacggaa

SEQ ID NO: 898 - DNA, 16 bp, Artificial sequence
  Synthetic oligonucleotide
gcaccaactctgaacg

SEQ ID NO: 899 - DNA, 16 bp, Artificial sequence
  Synthetic oligonucleotide
gaatacactgcaccaa

SEQ ID NO: 900 - DNA, 16 bp, Artificial sequence
  Synthetic oligonucleotide
ccattatgaatacact

SEQ ID NO: 901 - DNA, 16 bp, Artificial sequence
  Synthetic oligonucleotide
tcacattcggctgttt

SEQ ID NO: 902 - DNA, 16 bp, Artificial sequence
  Synthetic oligonucleotide
ggcctttgagcacacc

SEQ ID NO: 903 - DNA, 16 bp, Artificial sequence
  Synthetic oligonucleotide
ggagaggaccggcctt

SEQ ID NO: 904 - DNA, 16 bp, Artificial sequence
  Synthetic oligonucleotide
aagggcgcaggaaagg

SEQ ID NO: 905 - DNA, 16 bp, Artificial sequence
  Synthetic oligonucleotide
ggctcctacccgccca

SEQ ID NO: 906 - DNA, 16 bp, Artificial sequence
  Synthetic oligonucleotide
caacctgcagccagca

SEQ ID NO: 907 - DNA, 16 bp, Artificial sequence
  Synthetic oligonucleotide
aacaaagctgcaatgc

SEQ ID NO: 908 - DNA, 16 bp, Artificial sequence
  Synthetic oligonucleotide
acgaccaggcctgtcg

SEQ ID NO: 909 - DNA, 16 bp, Artificial sequence
  Synthetic oligonucleotide
taacgaccaggcctgt

SEQ ID NO: 910 - DNA, 16 bp, Artificial sequence
  Synthetic oligonucleotide
tttcactgcaagtccc

SEQ ID NO: 911 - DNA, 16 bp, Artificial sequence
  Synthetic oligonucleotide
ctgccaaatcacaaag

SEQ ID NO: 912 - DNA, 16 bp, Artificial sequence
  Synthetic oligonucleotide
agactgccaaatcaca

SEQ ID NO: 913 - DNA, 16 bp, Artificial sequence
  Synthetic oligonucleotide
cagactgccaaatcac

SEQ ID NO: 914 - DNA, 16 bp, Artificial sequence
  Synthetic oligonucleotide
acagactgccaaatca

SEQ ID NO: 915 - DNA, 16 bp, Artificial sequence
  Synthetic oligonucleotide
cacagactgccaaatc

SEQ ID NO: 916 - DNA, 16 bp, Artificial sequence
  Synthetic oligonucleotide
gcacagactgccaaat

SEQ ID NO: 917 - DNA, 16 bp, Artificial sequence
  Synthetic oligonucleotide
agtcaggcacagactg

SEQ ID NO: 918 - DNA, 16 bp, Artificial sequence
  Synthetic oligonucleotide
ccagagagtcaggcac

SEQ ID NO: 919 - DNA, 16 bp, Artificial sequence
  Synthetic oligonucleotide
caaggacctgttctgg

SEQ ID NO: 920 - DNA, 16 bp, Artificial sequence
  Synthetic oligonucleotide
catcagacctctccca

SEQ ID NO: 921 - DNA, 16 bp, Artificial sequence
  Synthetic oligonucleotide
actcaaaccaggacag

SEQ ID NO: 922 - DNA, 16 bp, Artificial sequence
  Synthetic oligonucleotide
acccactcaaaccagg

SEQ ID NO: 923 - DNA, 16 bp, Artificial sequence
  Synthetic oligonucleotide
gctgaataacctacaa

SEQ ID NO: 924 - DNA, 16 bp, Artificial sequence
  Synthetic oligonucleotide
tgcagctgaataacct

SEQ ID NO: 925 - DNA, 16 bp, Artificial sequence
  Synthetic oligonucleotide
ctaactgggcaggtcc

SEQ ID NO: 926 - DNA, 16 bp, Artificial sequence
  Synthetic oligonucleotide
tacaagtggttgctgg

SEQ ID NO: 927 - DNA, 16 bp, Artificial sequence
  Synthetic oligonucleotide
aactacaagtggttgc

SEQ ID NO: 928 - DNA, 16 bp, Artificial sequence
  Synthetic oligonucleotide
aaataactacaagtgg

SEQ ID NO: 929 - DNA, 16 bp, Artificial sequence
  Synthetic oligonucleotide
tgggagcacttctttt

SEQ ID NO: 930 - DNA, 16 bp, Artificial sequence
  Synthetic oligonucleotide
ctccactgcctcctac

SEQ ID NO: 931 - DNA, 16 bp, Artificial sequence
  Synthetic oligonucleotide
acaggatggagcaatg

SEQ ID NO: 932 - DNA, 16 bp, Artificial sequence
  Synthetic oligonucleotide
ctgattaactttcctt

SEQ ID NO: 933 - DNA, 16 bp, Artificial sequence
  Synthetic oligonucleotide
gatcacaattccaagc

SEQ ID NO: 934 - DNA, 16 bp, Artificial sequence
  Synthetic oligonucleotide
tcccagttcatgatca

SEQ ID NO: 935 - DNA, 16 bp, Artificial sequence
  Synthetic oligonucleotide
gaaaccatgagctgtt

SEQ ID NO: 936 - DNA, 16 bp, Artificial sequence
  Synthetic oligonucleotide
gctcatgagcatttgg

SEQ ID NO: 937 - DNA, 16 bp, Artificial sequence
  Synthetic oligonucleotide
cacaagcacctgtcca

SEQ ID NO: 938 - DNA, 16 bp, Artificial sequence
  Synthetic oligonucleotide
ctgcagggtactaagg

SEQ ID NO: 939 - DNA, 16 bp, Artificial sequence
  Synthetic oligonucleotide
gagttctaggccgtca

SEQ ID NO: 940 - DNA, 16 bp, Artificial sequence
  Synthetic oligonucleotide
actcatcctgttggca

SEQ ID NO: 941 - DNA, 16 bp, Artificial sequence
  Synthetic oligonucleotide
acacagtaacaacaat

SEQ ID NO: 942 - DNA, 16 bp, Artificial sequence
  Synthetic oligonucleotide
ttatgacacagtaaca

SEQ ID NO: 943 - DNA, 16 bp, Artificial sequence
  Synthetic oligonucleotide
aaggaattatgacaca

SEQ ID NO: 944 - DNA, 16 bp, Artificial sequence
  Synthetic oligonucleotide
ccaggaaccagcactt

SEQ ID NO: 945 - DNA, 16 bp, Artificial sequence
  Synthetic oligonucleotide
aagttatctgggaagc

SEQ ID NO: 946 - DNA, 16 bp, Artificial sequence
  Synthetic oligonucleotide
aatagttttctctcaa

SEQ ID NO: 947 - DNA, 16 bp, Artificial sequence
  Synthetic oligonucleotide
taatagttttctctca

SEQ ID NO: 948 - DNA, 16 bp, Artificial sequence
  Synthetic oligonucleotide
caaaacagtggaccat

SEQ ID NO: 949 - DNA, 16 bp, Artificial sequence
  Synthetic oligonucleotide
catgacagcaaagcaa

SEQ ID NO: 950 - DNA, 16 bp, Artificial sequence
  Synthetic oligonucleotide
ctacagttccagaaca

SEQ ID NO: 951 - DNA, 16 bp, Artificial sequence
  Synthetic oligonucleotide
atagattatccaagta

SEQ ID NO: 952 - DNA, 16 bp, Artificial sequence
  Synthetic oligonucleotide
cacaatcactgttcct

SEQ ID NO: 953 - DNA, 16 bp, Artificial sequence
  Synthetic oligonucleotide
caccaaaacaagtgtc

SEQ ID NO: 954 - DNA, 16 bp, Artificial sequence
  Synthetic oligonucleotide
cctcagggctgccacc

SEQ ID NO: 955 - DNA, 16 bp, Artificial sequence
  Synthetic oligonucleotide
ggctaccagccttgct

SEQ ID NO: 956 - DNA, 16 bp, Artificial sequence
  Synthetic oligonucleotide
gcaggctaccagcctt

SEQ ID NO: 957 - DNA, 16 bp, Artificial sequence
  Synthetic oligonucleotide
ctgctagggatactga

SEQ ID NO: 958 - DNA, 16 bp, Artificial sequence
  Synthetic oligonucleotide
cctttctactagaaaa

SEQ ID NO: 959 - DNA, 16 bp, Artificial sequence
  Synthetic oligonucleotide
acacacagcagaaggc

SEQ ID NO: 960 - DNA, 16 bp, Artificial sequence
  Synthetic oligonucleotide
gtaacacacagcagaa

SEQ ID NO: 961 - DNA, 16 bp, Artificial sequence
  Synthetic oligonucleotide
ctttcttggtgtgtta

SEQ ID NO: 962 - DNA, 16 bp, Artificial sequence
  Synthetic oligonucleotide
gggatcaggtgagtgt

SEQ ID NO: 963 - DNA, 16 bp, Artificial sequence
  Synthetic oligonucleotide
gtttaggtagagtggc

SEQ ID NO: 964 - DNA, 16 bp, Artificial sequence
  Synthetic oligonucleotide
tcccaggtgaacccac

SEQ ID NO: 965 - DNA, 16 bp, Artificial sequence
  Synthetic oligonucleotide
tccacgggagtggaag

SEQ ID NO: 966 - DNA, 16 bp, Artificial sequence
  Synthetic oligonucleotide
ttctacaccttttaag

SEQ ID NO: 967 - DNA, 16 bp, Artificial sequence
  Synthetic oligonucleotide
cttagagtataaatac

SEQ ID NO: 968 - DNA, 16 bp, Artificial sequence
  Synthetic oligonucleotide
tcaaaaaatgtcccca

SEQ ID NO: 969 - DNA, 16 bp, Artificial sequence
  Synthetic oligonucleotide
cacccctatcaaaaaa

SEQ ID NO: 970 - DNA, 16 bp, Artificial sequence
  Synthetic oligonucleotide
ttaaataactgtcctc

SEQ ID NO: 971 - DNA, 16 bp, Artificial sequence
  Synthetic oligonucleotide
gagctaatgacactgg

SEQ ID NO: 972 - DNA, 16 bp, Artificial sequence
  Synthetic oligonucleotide
ttaaaactgagctaat

SEQ ID NO: 973 - DNA, 16 bp, Artificial sequence
  Synthetic oligonucleotide
cgtgagtaaattctta

SEQ ID NO: 974 - DNA, 16 bp, Artificial sequence
  Synthetic oligonucleotide
ggctaagtgccaggtg

SEQ ID NO: 975 - DNA, 16 bp, Artificial sequence
  Synthetic oligonucleotide
gaaagttacagaactc

SEQ ID NO: 976 - DNA, 16 bp, Artificial sequence
  Synthetic oligonucleotide
cagggcagctccgaga

SEQ ID NO: 977 - DNA, 16 bp, Artificial sequence
  Synthetic oligonucleotide
ccgttactggacacag

SEQ ID NO: 978 - DNA, 16 bp, Artificial sequence
  Synthetic oligonucleotide
caccgttactggacac

SEQ ID NO: 979 - DNA, 16 bp, Artificial sequence
  Synthetic oligonucleotide
accatatcactccttc

SEQ ID NO: 980 - DNA, 16 bp, Artificial sequence
  Synthetic oligonucleotide
ttctaggtgaaccata

SEQ ID NO: 981 - DNA, 16 bp, Artificial sequence
  Synthetic oligonucleotide
gcatatgccactgaga

SEQ ID NO: 982 - DNA, 16 bp, Artificial sequence
  Synthetic oligonucleotide
cgccgcggcatatgcc

SEQ ID NO: 983 - DNA, 16 bp, Artificial sequence
  Synthetic oligonucleotide
cgctaggtcacactca

SEQ ID NO: 984 - DNA, 16 bp, Artificial sequence
  Synthetic oligonucleotide
gccctgttctgcgcta

SEQ ID NO: 985 - DNA, 16 bp, Artificial sequence
  Synthetic oligonucleotide
acacaagagggaagcc

SEQ ID NO: 986 - DNA, 16 bp, Artificial sequence
  Synthetic oligonucleotide
cagaaggaccaagtcc

SEQ ID NO: 987 - DNA, 16 bp, Artificial sequence
  Synthetic oligonucleotide
agtcagccagaaggac

SEQ ID NO: 988 - DNA, 16 bp, Artificial sequence
  Synthetic oligonucleotide
gcacaccttccaagca

SEQ ID NO: 989 - DNA, 16 bp, Artificial sequence
  Synthetic oligonucleotide
taaacaaaccacaggg

SEQ ID NO: 990 - DNA, 16 bp, Artificial sequence
  Synthetic oligonucleotide
ccataaacaaaccaca

SEQ ID NO: 991 - DNA, 16 bp, Artificial sequence
  Synthetic oligonucleotide
gggagacctacctctg

SEQ ID NO: 992 - DNA, 16 bp, Artificial sequence
  Synthetic oligonucleotide
accaaaacccgggaga

SEQ ID NO: 993 - DNA, 16 bp, Artificial sequence
  Synthetic oligonucleotide
gttcttcctgctgtca

SEQ ID NO: 994 - DNA, 16 bp, Artificial sequence
  Synthetic oligonucleotide
aaccacagctcctgtt

SEQ ID NO: 995 - DNA, 16 bp, Artificial sequence
  Synthetic oligonucleotide
ccagatgtttccccac

SEQ ID NO: 996 - DNA, 16 bp, Artificial sequence
  Synthetic oligonucleotide
cattagatactgtctt

SEQ ID NO: 997 - DNA, 16 bp, Artificial sequence
  Synthetic oligonucleotide
gacattagatactgtc

SEQ ID NO: 998 - DNA, 16 bp, Artificial sequence
  Synthetic oligonucleotide
tcccacttctcctctg

SEQ ID NO: 999 - DNA, 16 bp, Artificial sequence
  Synthetic oligonucleotide
aaaacatcccacttct

SEQ ID NO: 1000 - DNA, 16 bp, Artificial sequence
  Synthetic oligonucleotide
ttacaaagggaaagtc

SEQ ID NO: 1001 - DNA, 16 bp, Artificial sequence
  Synthetic oligonucleotide
ctgccaacggcacagt

SEQ ID NO: 1002 - DNA, 16 bp, Artificial sequence
  Synthetic oligonucleotide
cagacagctaatctgc

SEQ ID NO: 1003 - DNA, 16 bp, Artificial sequence
  Synthetic oligonucleotide
atgcagacagctaatc

SEQ ID NO: 1004 - DNA, 16 bp, Artificial sequence
  Synthetic oligonucleotide
cctcacttagcctgca

SEQ ID NO: 1005 - DNA, 16 bp, Artificial sequence
  Synthetic oligonucleotide
ctcttgatgatcctca

SEQ ID NO: 1006 - DNA, 16 bp, Artificial sequence
  Synthetic oligonucleotide
tgacaaggtccccagg

SEQ ID NO: 1007 - DNA, 16 bp, Artificial sequence
  Synthetic oligonucleotide
tactgattcatgaggg

SEQ ID NO: 1008 - DNA, 16 bp, Artificial sequence
  Synthetic oligonucleotide
cactgataactaactt

SEQ ID NO: 1009 - DNA, 16 bp, Artificial sequence
  Synthetic oligonucleotide
ccccactgagcaggag

SEQ ID NO: 1010 - DNA, 16 bp, Artificial sequence
  Synthetic oligonucleotide
ccccagcagggttttg

SEQ ID NO: 1011 - DNA, 16 bp, Artificial sequence
  Synthetic oligonucleotide
tacttggaagagtttg

SEQ ID NO: 1012 - DNA, 16 bp, Artificial sequence
  Synthetic oligonucleotide
cacccatacttggaag

SEQ ID NO: 1013 - DNA, 16 bp, Artificial sequence
  Synthetic oligonucleotide
tttctgaacagagtcc

SEQ ID NO: 1014 - DNA, 16 bp, Artificial sequence
  Synthetic oligonucleotide
gtggtatagcatgcat

SEQ ID NO: 1015 - DNA, 16 bp, Artificial sequence
  Synthetic oligonucleotide
gcagatgtatacaaat

SEQ ID NO: 1016 - DNA, 16 bp, Artificial sequence
  Synthetic oligonucleotide
agatatcggccccctg

SEQ ID NO: 1017 - DNA, 16 bp, Artificial sequence
  Synthetic oligonucleotide
tcataagcatagattt

SEQ ID NO: 1018 - DNA, 16 bp, Artificial sequence
  Synthetic oligonucleotide
ttgcacccccataact

SEQ ID NO: 1019 - DNA, 16 bp, Artificial sequence
  Synthetic oligonucleotide
agcacaatatgaatgt

SEQ ID NO: 1020 - DNA, 16 bp, Artificial sequence
  Synthetic oligonucleotide
agggaagttagtgttt

SEQ ID NO: 1021 - DNA, 16 bp, Artificial sequence
  Synthetic oligonucleotide
aagtgtccatcaagca

SEQ ID NO: 1022 - DNA, 16 bp, Artificial sequence
  Synthetic oligonucleotide
caagtgtccatcaagc

SEQ ID NO: 1023 - DNA, 16 bp, Artificial sequence
  Synthetic oligonucleotide
ccaagtgtccatcaag

SEQ ID NO: 1024 - DNA, 16 bp, Artificial sequence
  Synthetic oligonucleotide
gccaagtgtccatcaa

SEQ ID NO: 1025 - DNA, 16 bp, Artificial sequence
  Synthetic oligonucleotide
agccaagtgtccatca

SEQ ID NO: 1026 - DNA, 16 bp, Artificial sequence
  Synthetic oligonucleotide
gcaagccaagtgtcca

SEQ ID NO: 1027 - DNA, 16 bp, Artificial sequence
  Synthetic oligonucleotide
agaactgaaagcggcg

SEQ ID NO: 1028 - DNA, 16 bp, Artificial sequence
  Synthetic oligonucleotide
gtaatttagcaattcc

SEQ ID NO: 1029 - DNA, 16 bp, Artificial sequence
  Synthetic oligonucleotide
tgtaatttagcaattc

SEQ ID NO: 1030 - DNA, 16 bp, Artificial sequence
  Synthetic oligonucleotide
tgccgacacatgaggc

SEQ ID NO: 1031 - DNA, 16 bp, Artificial sequence
  Synthetic oligonucleotide
ttggacacactcactg

SEQ ID NO: 1032 - DNA, 16 bp, Artificial sequence
  Synthetic oligonucleotide
aagttaatcattactt

SEQ ID NO: 1033 - DNA, 16 bp, Artificial sequence
  Synthetic oligonucleotide
aaaagttaatcattac

SEQ ID NO: 1034 - DNA, 16 bp, Artificial sequence
  Synthetic oligonucleotide
cagactggaaaagtta

SEQ ID NO: 1035 - DNA, 16 bp, Artificial sequence
  Synthetic oligonucleotide
gtgcagactggaaaag

SEQ ID NO: 1036 - DNA, 16 bp, Artificial sequence
  Synthetic oligonucleotide
gccagggccgcactgt

SEQ ID NO: 1037 - DNA, 16 bp, Artificial sequence
  Synthetic oligonucleotide
actttacaacccaata

SEQ ID NO: 1038 - DNA, 16 bp, Artificial sequence
  Synthetic oligonucleotide
gcccccctccccgtgc

SEQ ID NO: 1039 - DNA, 16 bp, Artificial sequence
  Synthetic oligonucleotide
tggaaaagctccttct

SEQ ID NO: 1040 - DNA, 16 bp, Artificial sequence
  Synthetic oligonucleotide
tccgatggaaaagctc

SEQ ID NO: 1041 - DNA, 16 bp, Artificial sequence
  Synthetic oligonucleotide
atcattaagccaattt

SEQ ID NO: 1042 - DNA, 16 bp, Artificial sequence
  Synthetic oligonucleotide
gcatcattaagccaat

SEQ ID NO: 1043 - DNA, 16 bp, Artificial sequence
  Synthetic oligonucleotide
atacaaaccactgcat

SEQ ID NO: 1044 - DNA, 16 bp, Artificial sequence
  Synthetic oligonucleotide
tcccaactgggcagct

SEQ ID NO: 1045 - DNA, 16 bp, Artificial sequence
  Synthetic oligonucleotide
ctgagagtgtaggaga

SEQ ID NO: 1046 - DNA, 16 bp, Artificial sequence
  Synthetic oligonucleotide
cttacctcacccacct

SEQ ID NO: 1047 - DNA, 16 bp, Artificial sequence
  Synthetic oligonucleotide
tctcttacctcaccca

SEQ ID NO: 1048 - DNA, 16 bp, Artificial sequence
  Synthetic oligonucleotide
gtctcttacctcaccc

SEQ ID NO: 1049 - DNA, 16 bp, Artificial sequence
  Synthetic oligonucleotide
aagtctcttacctcac

SEQ ID NO: 1050 - DNA, 16 bp, Artificial sequence
  Synthetic oligonucleotide
caagtctcttacctca

SEQ ID NO: 1051 - DNA, 16 bp, Artificial sequence
  Synthetic oligonucleotide
ccaactccattcataa

SEQ ID NO: 1052 - DNA, 16 bp, Artificial sequence
  Synthetic oligonucleotide
agccaactccattcat

SEQ ID NO: 1053 - DNA, 16 bp, Artificial sequence
  Synthetic oligonucleotide
ctcagaggaagggtgg

SEQ ID NO: 1054 - DNA, 16 bp, Artificial sequence
  Synthetic oligonucleotide
ggcctcagaggaaggg

SEQ ID NO: 1055 - DNA, 16 bp, Artificial sequence
  Synthetic oligonucleotide
ctgagagaggcctcag

SEQ ID NO: 1056 - DNA, 16 bp, Artificial sequence
  Synthetic oligonucleotide
gctgacgcggcttcct

SEQ ID NO: 1057 - DNA, 16 bp, Artificial sequence
  Synthetic oligonucleotide
cacaaatcaaaagctc

SEQ ID NO: 1058 - DNA, 16 bp, Artificial sequence
  Synthetic oligonucleotide
tggagaatgtaattga

SEQ ID NO: 1059 - DNA, 16 bp, Artificial sequence
  Synthetic oligonucleotide
catttatctcgccatg

SEQ ID NO: 1060 - DNA, 16 bp, Artificial sequence
  Synthetic oligonucleotide
tcctaagagcatttat

SEQ ID NO: 1061 - DNA, 16 bp, Artificial sequence
  Synthetic oligonucleotide
tcttttatcactgtca

SEQ ID NO: 1062 - DNA, 16 bp, Artificial sequence
  Synthetic oligonucleotide
tcaagagacggtgagc

SEQ ID NO: 1063 - DNA, 16 bp, Artificial sequence
  Synthetic oligonucleotide
tactattcatcaccct

SEQ ID NO: 1064 - DNA, 16 bp, Artificial sequence
  Synthetic oligonucleotide
actttttactctgtct

SEQ ID NO: 1065 - DNA, 16 bp, Artificial sequence
  Synthetic oligonucleotide
agaaatgactttttac

SEQ ID NO: 1066 - DNA, 16 bp, Artificial sequence
  Synthetic oligonucleotide
ctttaatttcagagtc

SEQ ID NO: 1067 - DNA, 16 bp, Artificial sequence
  Synthetic oligonucleotide
tctttaatttcagagt

SEQ ID NO: 1068 - DNA, 16 bp, Artificial sequence
  Synthetic oligonucleotide
ctctaaaccaactttt

SEQ ID NO: 1069 - DNA, 16 bp, Artificial sequence
  Synthetic oligonucleotide
gcatttaatttgcaac

SEQ ID NO: 1070 - DNA, 16 bp, Artificial sequence
  Synthetic oligonucleotide
gcacaagtcactggcc

SEQ ID NO: 1071 - DNA, 16 bp, Artificial sequence
  Synthetic oligonucleotide
tcttaaaaaaagggag

SEQ ID NO: 1072 - DNA, 16 bp, Artificial sequence
  Synthetic oligonucleotide
ctctaagtggctcatg

SEQ ID NO: 1073 - DNA, 16 bp, Artificial sequence
  Synthetic oligonucleotide
agaaaatgcccaccag

SEQ ID NO: 1074 - DNA, 16 bp, Artificial sequence
  Synthetic oligonucleotide
cagaaaatgcccacca

SEQ ID NO: 1075 - DNA, 16 bp, Artificial sequence
  Synthetic oligonucleotide
cgctcagaaaatgccc

SEQ ID NO: 1076 - DNA, 16 bp, Artificial sequence
  Synthetic oligonucleotide
tctccagccgctcaga

SEQ ID NO: 1077 - DNA, 16 bp, Artificial sequence
  Synthetic oligonucleotide
tctgaggctcctgggt

SEQ ID NO: 1078 - DNA, 16 bp, Artificial sequence
  Synthetic oligonucleotide
gtggagagtgctgcac

SEQ ID NO: 1079 - DNA, 16 bp, Artificial sequence
  Synthetic oligonucleotide
agcttgtggagagtgc

SEQ ID NO: 1080 - DNA, 16 bp, Artificial sequence
  Synthetic oligonucleotide
tcctcaggaaacacag

SEQ ID NO: 1081 - DNA, 16 bp, Artificial sequence
  Synthetic oligonucleotide
gtaaaacttgctgaga

SEQ ID NO: 1082 - DNA, 16 bp, Artificial sequence
  Synthetic oligonucleotide
cacaaggacccttgct

SEQ ID NO: 1083 - DNA, 16 bp, Artificial sequence
  Synthetic oligonucleotide
ataattcacaaggacc

SEQ ID NO: 1084 - DNA, 16 bp, Artificial sequence
  Synthetic oligonucleotide
gactccagtgccaatc

SEQ ID NO: 1085 - DNA, 16 bp, Artificial sequence
  Synthetic oligonucleotide
tcttcagggacaagcc

SEQ ID NO: 1086 - DNA, 16 bp, Artificial sequence
  Synthetic oligonucleotide
tcaaaggttaacagca

SEQ ID NO: 1087 - DNA, 16 bp, Artificial sequence
  Synthetic oligonucleotide
ggacatctcaaaggtt

SEQ ID NO: 1088 - DNA, 16 bp, Artificial sequence
  Synthetic oligonucleotide
ctccacaacggacatc

SEQ ID NO: 1089 - DNA, 16 bp, Artificial sequence
  Synthetic oligonucleotide
aacggttgcctcatcc

SEQ ID NO: 1090 - DNA, 16 bp, Artificial sequence
  Synthetic oligonucleotide
ttgcacctggcaacct

SEQ ID NO: 1091 - DNA, 16 bp, Artificial sequence
  Synthetic oligonucleotide
ggccgcctcctgcagg

SEQ ID NO: 1092 - DNA, 16 bp, Artificial sequence
  Synthetic oligonucleotide
ggcacggccgcctcct

SEQ ID NO: 1093 - DNA, 16 bp, Artificial sequence
  Synthetic oligonucleotide
ataatgaagtgatatt

SEQ ID NO: 1094 - DNA, 16 bp, Artificial sequence
  Synthetic oligonucleotide
acttggataatgaagt

SEQ ID NO: 1095 - DNA, 16 bp, Artificial sequence
  Synthetic oligonucleotide
ctgtgaggcacttgga

SEQ ID NO: 1096 - DNA, 16 bp, Artificial sequence
  Synthetic oligonucleotide
gacccacggttaaatg

SEQ ID NO: 1097 - DNA, 16 bp, Artificial sequence
  Synthetic oligonucleotide
atgacccacggttaaa

SEQ ID NO: 1098 - DNA, 16 bp, Artificial sequence
  Synthetic oligonucleotide
cagtaaagacatgagc

SEQ ID NO: 1099 - DNA, 16 bp, Artificial sequence
  Synthetic oligonucleotide
ttaggaacaagggcaa

SEQ ID NO: 1100 - DNA, 16 bp, Artificial sequence
  Synthetic oligonucleotide
gttatttaattaccct

SEQ ID NO: 1101 - DNA, 16 bp, Artificial sequence
  Synthetic oligonucleotide
tcttacaaagagttat

SEQ ID NO: 1102 - DNA, 16 bp, Artificial sequence
  Synthetic oligonucleotide
cttcagcctgtgtttg

SEQ ID NO: 1103 - DNA, 16 bp, Artificial sequence
  Synthetic oligonucleotide
gaggacttcagcctgt

SEQ ID NO: 1104 - DNA, 16 bp, Artificial sequence
  Synthetic oligonucleotide
aaaggagaggacttca

SEQ ID NO: 1105 - DNA, 16 bp, Artificial sequence
  Synthetic oligonucleotide
taaagcataaaatcct

SEQ ID NO: 1106 - DNA, 16 bp, Artificial sequence
  Synthetic oligonucleotide
ctttaaggtgttgccc

SEQ ID NO: 1107 - DNA, 16 bp, Artificial sequence
  Synthetic oligonucleotide
gttcattttaaagcat

SEQ ID NO: 1108 - DNA, 16 bp, Artificial sequence
  Synthetic oligonucleotide
taaaacagtatgtgtt

SEQ ID NO: 1109 - DNA, 16 bp, Artificial sequence
  Synthetic oligonucleotide
aaaactcacagtcctt

SEQ ID NO: 1110 - DNA, 16 bp, Artificial sequence
  Synthetic oligonucleotide
cctgaatcgggcccac

SEQ ID NO: 1111 - DNA, 16 bp, Artificial sequence
  Synthetic oligonucleotide
aaacacagttccctga

SEQ ID NO: 1112 - DNA, 16 bp, Artificial sequence
  Synthetic oligonucleotide
agaaacacagttccct

SEQ ID NO: 1113 - DNA, 16 bp, Artificial sequence
  Synthetic oligonucleotide
gaattccccgccattt

SEQ ID NO: 1114 - DNA, 16 bp, Artificial sequence
  Synthetic oligonucleotide
cactacagagattccc

SEQ ID NO: 1115 - DNA, 16 bp, Artificial sequence
  Synthetic oligonucleotide
ccgcacgacatccccc

SEQ ID NO: 1116 - DNA, 16 bp, Artificial sequence
  Synthetic oligonucleotide
caaaggcccctcgaac

SEQ ID NO: 1117 - DNA, 16 bp, Artificial sequence
  Synthetic oligonucleotide
gttaggacagctccag

SEQ ID NO: 1118 - DNA, 16 bp, Artificial sequence
  Synthetic oligonucleotide
caccagcagcctctgt

SEQ ID NO: 1119 - DNA, 16 bp, Artificial sequence
  Synthetic oligonucleotide
tgctcctccctcgctg

SEQ ID NO: 1120 - DNA, 16 bp, Artificial sequence
  Synthetic oligonucleotide
aacaaacctggcctgg

SEQ ID NO: 1121 - DNA, 16 bp, Artificial sequence
  Synthetic oligonucleotide
gcttattttcccaatt

SEQ ID NO: 1122 - DNA, 16 bp, Artificial sequence
  Synthetic oligonucleotide
cagcacatccaccctt

SEQ ID NO: 1123 - DNA, 16 bp, Artificial sequence
  Synthetic oligonucleotide
ccctcttccgggaggc

SEQ ID NO: 1124 - DNA, 16 bp, Artificial sequence
  Synthetic oligonucleotide
ctacaccaaagacctg

SEQ ID NO: 1125 - DNA, 16 bp, Artificial sequence
  Synthetic oligonucleotide
gctacaccaaagacct

SEQ ID NO: 1126 - DNA, 16 bp, Artificial sequence
  Synthetic oligonucleotide
ataaacttgtgagcgc

SEQ ID NO: 1127 - DNA, 16 bp, Artificial sequence
  Synthetic oligonucleotide
tgctaataaacttgtg

SEQ ID NO: 1128 - DNA, 16 bp, Artificial sequence
  Synthetic oligonucleotide
ttcacttgtttctgca

SEQ ID NO: 1129 - DNA, 16 bp, Artificial sequence
  Synthetic oligonucleotide
tcatcaggcattcact

SEQ ID NO: 1130 - DNA, 16 bp, Artificial sequence
  Synthetic oligonucleotide
catggcggaagatggg

SEQ ID NO: 1131 - DNA, 16 bp, Artificial sequence
  Synthetic oligonucleotide
ccatggcggaagatgg

SEQ ID NO: 1132 - DNA, 16 bp, Artificial sequence
  Synthetic oligonucleotide
tgtatttgttaacaaa

SEQ ID NO: 1133 - DNA, 16 bp, Artificial sequence
  Synthetic oligonucleotide
gacttgggaccataaa

SEQ ID NO: 1134 - DNA, 16 bp, Artificial sequence
  Synthetic oligonucleotide
taagtaggagccagcg

SEQ ID NO: 1135 - DNA, 16 bp, Artificial sequence
  Synthetic oligonucleotide
gggcattctgactcct

SEQ ID NO: 1136 - DNA, 16 bp, Artificial sequence
  Synthetic oligonucleotide
taattttcctcaacag

SEQ ID NO: 1137 - DNA, 16 bp, Artificial sequence
  Synthetic oligonucleotide
cgcttccctacacagt

SEQ ID NO: 1138 - DNA, 16 bp, Artificial sequence
  Synthetic oligonucleotide
ccttaacaaagcttcc

SEQ ID NO: 1139 - DNA, 16 bp, Artificial sequence
  Synthetic oligonucleotide
accttaacaaagcttc

SEQ ID NO: 1140 - DNA, 16 bp, Artificial sequence
  Synthetic oligonucleotide
aggaacctatctggta

SEQ ID NO: 1141 - DNA, 16 bp, Artificial sequence
  Synthetic oligonucleotide
cacctatgcgatggtc

SEQ ID NO: 1142 - DNA, 16 bp, Artificial sequence
  Synthetic oligonucleotide
tgacacagccagagct

SEQ ID NO: 1143 - DNA, 16 bp, Artificial sequence
  Synthetic oligonucleotide
atcctgatgagaaaac

SEQ ID NO: 1144 - DNA, 16 bp, Artificial sequence
  Synthetic oligonucleotide
ttgaaggccagctcct

SEQ ID NO: 1145 - DNA, 16 bp, Artificial sequence
  Synthetic oligonucleotide
atggaaccttgaaggc

SEQ ID NO: 1146 - DNA, 16 bp, Artificial sequence
  Synthetic oligonucleotide
agttacagatctttca

SEQ ID NO: 1147 - DNA, 16 bp, Artificial sequence
  Synthetic oligonucleotide
tggagttacagatctt

SEQ ID NO: 1148 - DNA, 16 bp, Artificial sequence
  Synthetic oligonucleotide
gcctcaaaaagcctca

SEQ ID NO: 1149 - DNA, 16 bp, Artificial sequence
  Synthetic oligonucleotide
ttttagggcctcaaaa

SEQ ID NO: 1150 - DNA, 16 bp, Artificial sequence
  Synthetic oligonucleotide
aagaagttgggaatct

SEQ ID NO: 1151 - DNA, 16 bp, Artificial sequence
  Synthetic oligonucleotide
cagtatgccaccacgc

SEQ ID NO: 1152 - DNA, 16 bp, Artificial sequence
  Synthetic oligonucleotide
tcccagtatgccacca

SEQ ID NO: 1153 - DNA, 16 bp, Artificial sequence
  Synthetic oligonucleotide
tctcctcccagtatgc

SEQ ID NO: 1154 - DNA, 16 bp, Artificial sequence
  Synthetic oligonucleotide
agcctccccactctcg

SEQ ID NO: 1155 - DNA, 16 bp, Artificial sequence
  Synthetic oligonucleotide
gtagagcctccccact

SEQ ID NO: 1156 - DNA, 16 bp, Artificial sequence
  Synthetic oligonucleotide
acagtagagcctcccc

SEQ ID NO: 1157 - DNA, 16 bp, Artificial sequence
  Synthetic oligonucleotide
gacacagtagagcctc

SEQ ID NO: 1158 - DNA, 16 bp, Artificial sequence
  Synthetic oligonucleotide
ctggacacagtagagc

SEQ ID NO: 1159 - DNA, 16 bp, Artificial sequence
  Synthetic oligonucleotide
ctcctggacacagtag

SEQ ID NO: 1160 - DNA, 16 bp, Artificial sequence
  Synthetic oligonucleotide
agagagggctcctgga

SEQ ID NO: 1161 - DNA, 16 bp, Artificial sequence
  Synthetic oligonucleotide
cgaggcaaaagccatt

SEQ ID NO: 1162 - DNA, 16 bp, Artificial sequence
  Synthetic oligonucleotide
gtccgaggcaaaagcc

SEQ ID NO: 1163 - DNA, 16 bp, Artificial sequence
  Synthetic oligonucleotide
gctgtccgaggcaaaa

SEQ ID NO: 1164 - DNA, 16 bp, Artificial sequence
  Synthetic oligonucleotide
attgagctgtccgagg

SEQ ID NO: 1165 - DNA, 16 bp, Artificial sequence
  Synthetic oligonucleotide
ccgaattgagctgtcc

SEQ ID NO: 1166 - DNA, 16 bp, Artificial sequence
  Synthetic oligonucleotide
gttgtccgaattgagc

SEQ ID NO: 1167 - DNA, 16 bp, Artificial sequence
  Synthetic oligonucleotide
ctcttgttgtccgaat

SEQ ID NO: 1168 - DNA, 16 bp, Artificial sequence
  Synthetic oligonucleotide
ctgactcttgttgtcc

SEQ ID NO: 1169 - DNA, 16 bp, Artificial sequence
  Synthetic oligonucleotide
cagctgactcttgttg

SEQ ID NO: 1170 - DNA, 16 bp, Artificial sequence
  Synthetic oligonucleotide
caccagctgactcttg

SEQ ID NO: 1171 - DNA, 16 bp, Artificial sequence
  Synthetic oligonucleotide
ccacacaccatccacc

SEQ ID NO: 1172 - DNA, 16 bp, Artificial sequence
  Synthetic oligonucleotide
tacacccacacaccat

SEQ ID NO: 1173 - DNA, 16 bp, Artificial sequence
  Synthetic oligonucleotide
ttgtacacccacacac

SEQ ID NO: 1174 - DNA, 16 bp, Artificial sequence
  Synthetic oligonucleotide
tgcggttgtacaccca

SEQ ID NO: 1175 - DNA, 16 bp, Artificial sequence
  Synthetic oligonucleotide
tgctgcggttgtacac

SEQ ID NO: 1176 - DNA, 16 bp, Artificial sequence
  Synthetic oligonucleotide
aactgctgcggttgta

SEQ ID NO: 1177 - DNA, 16 bp, Artificial sequence
  Synthetic oligonucleotide
ggtaactgctgcggtt

SEQ ID NO: 1178 - DNA, 16 bp, Artificial sequence
  Synthetic oligonucleotide
cggacttgatgaagat

SEQ ID NO: 1179 - DNA, 16 bp, Artificial sequence
  Synthetic oligonucleotide
tggcggacttgatgaa

SEQ ID NO: 1180 - DNA, 16 bp, Artificial sequence
  Synthetic oligonucleotide
gccttgatggagaaac

SEQ ID NO: 1181 - DNA, 16 bp, Artificial sequence
  Synthetic oligonucleotide
aaagccttgatggaga

SEQ ID NO: 1182 - DNA, 16 bp, Artificial sequence
  Synthetic oligonucleotide
tagtcgaaagccttga

SEQ ID NO: 1183 - DNA, 16 bp, Artificial sequence
  Synthetic oligonucleotide
gctgtacgccttctcg

SEQ ID NO: 1184 - DNA, 16 bp, Artificial sequence
  Synthetic oligonucleotide
gcaggctgtacgcctt

SEQ ID NO: 1185 - DNA, 16 bp, Artificial sequence
  Synthetic oligonucleotide
cgctgcaggctgtacg

SEQ ID NO: 1186 - DNA, 16 bp, Artificial sequence
  Synthetic oligonucleotide
ggccgctgcaggctgt

SEQ ID NO: 1187 - DNA, 16 bp, Artificial sequence
  Synthetic oligonucleotide
cattgggccgctgcag

SEQ ID NO: 1188 - DNA, 16 bp, Artificial sequence
  Synthetic oligonucleotide
ggtcattgggccgctg

SEQ ID NO: 1189 - DNA, 16 bp, Artificial sequence
  Synthetic oligonucleotide
ctgctgcataaactcg

SEQ ID NO: 1190 - DNA, 16 bp, Artificial sequence
  Synthetic oligonucleotide
cacaaagctgatctgc

SEQ ID NO: 1191 - DNA, 16 bp, Artificial sequence
  Synthetic oligonucleotide
cttcacaaagctgatc

SEQ ID NO: 1192 - DNA, 16 bp, Artificial sequence
  Synthetic oligonucleotide
gcccttcacaaagctg

SEQ ID NO: 1193 - DNA, 16 bp, Artificial sequence
  Synthetic oligonucleotide
ccccagcccttcacaa

SEQ ID NO: 1194 - DNA, 16 bp, Artificial sequence
  Synthetic oligonucleotide
tggccccagcccttca

SEQ ID NO: 1195 - DNA, 16 bp, Artificial sequence
  Synthetic oligonucleotide
agcactggccccagcc

SEQ ID NO: 1196 - DNA, 16 bp, Artificial sequence
  Synthetic oligonucleotide
tgtagcactggcccca

SEQ ID NO: 1197 - DNA, 16 bp, Artificial sequence
  Synthetic oligonucleotide
gggtgtagcactggcc

SEQ ID NO: 1198 - DNA, 16 bp, Artificial sequence
  Synthetic oligonucleotide
ggcgggtgtagcactg

SEQ ID NO: 1199 - DNA, 16 bp, Artificial sequence
  Synthetic oligonucleotide
tgctgatgaactggcg

SEQ ID NO: 1200 - DNA, 16 bp, Artificial sequence
  Synthetic oligonucleotide
gctaccggctgttgaa

SEQ ID NO: 1201 - DNA, 16 bp, Artificial sequence
  Synthetic oligonucleotide
ggctaccggctgttga

SEQ ID NO: 1202 - DNA, 16 bp, Artificial sequence
  Synthetic oligonucleotide
gcggctaccggctgtt

SEQ ID NO: 1203 - DNA, 16 bp, Artificial sequence
  Synthetic oligonucleotide
cgcggctaccggctgt

SEQ ID NO: 1204 - DNA, 16 bp, Artificial sequence
  Synthetic oligonucleotide
acgcggctaccggctg

SEQ ID NO: 1205 - DNA, 16 bp, Artificial sequence
  Synthetic oligonucleotide
cacgcggctaccggct

SEQ ID NO: 1206 - DNA, 16 bp, Artificial sequence
  Synthetic oligonucleotide
gcacgcggctaccggc

SEQ ID NO: 1207 - DNA, 16 bp, Artificial sequence
  Synthetic oligonucleotide
tccgcacgcggctacc

SEQ ID NO: 1208 - DNA, 16 bp, Artificial sequence
  Synthetic oligonucleotide
ccctccgcacgcggct

SEQ ID NO: 1209 - DNA, 16 bp, Artificial sequence
  Synthetic oligonucleotide
gtcccctccgcacgcg

SEQ ID NO: 1210 - DNA, 16 bp, Artificial sequence
  Synthetic oligonucleotide
agtagtttgaagtgtg

SEQ ID NO: 1211 - DNA, 16 bp, Artificial sequence
  Synthetic oligonucleotide
caaagtagtttgaagt

SEQ ID NO: 1212 - DNA, 16 bp, Artificial sequence
  Synthetic oligonucleotide
cagcaaagtagtttga

SEQ ID NO: 1213 - DNA, 16 bp, Artificial sequence
  Synthetic oligonucleotide
tagcagcaaagtagtt

SEQ ID NO: 1214 - DNA, 16 bp, Artificial sequence
  Synthetic oligonucleotide
tattagcagcaaagta

SEQ ID NO: 1215 - DNA, 16 bp, Artificial sequence
  Synthetic oligonucleotide
gaaaatattagcagca

SEQ ID NO: 1216 - DNA, 16 bp, Artificial sequence
  Synthetic oligonucleotide
gaggaaaatattagca

SEQ ID NO: 1217 - DNA, 16 bp, Artificial sequence
  Synthetic oligonucleotide
ctcaggaggaaaatat

SEQ ID NO: 1218 - DNA, 16 bp, Artificial sequence
  Synthetic oligonucleotide
gcactcaggaggaaaa

SEQ ID NO: 1219 - DNA, 16 bp, Artificial sequence
  Synthetic oligonucleotide
gcaagcactcaggagg

SEQ ID NO: 1220 - DNA, 16 bp, Artificial sequence
  Synthetic oligonucleotide
cgaggacgagaagaag

SEQ ID NO: 1221 - DNA, 16 bp, Artificial sequence
  Synthetic oligonucleotide
aaacgaggacgagaag

SEQ ID NO: 1222 - DNA, 16 bp, Artificial sequence
  Synthetic oligonucleotide
cacaaacgaggacgag

SEQ ID NO: 1223 - DNA, 16 bp, Artificial sequence
  Synthetic oligonucleotide
gaacacaaacgaggac

SEQ ID NO: 1224 - DNA, 16 bp, Artificial sequence
  Synthetic oligonucleotide
acagaacacaaacgag

SEQ ID NO: 1225 - DNA, 16 bp, Artificial sequence
  Synthetic oligonucleotide
gcgaaacaaaacagaa

SEQ ID NO: 1226 - DNA, 16 bp, Artificial sequence
  Synthetic oligonucleotide
agagcgaaacaaaaca

SEQ ID NO: 1227 - DNA, 16 bp, Artificial sequence
  Synthetic oligonucleotide
caaagagcgaaacaaa

SEQ ID NO: 1228 - DNA, 16 bp, Artificial sequence
  Synthetic oligonucleotide
tctcaaagagcgaaac

SEQ ID NO: 1229 - DNA, 16 bp, Artificial sequence
  Synthetic oligonucleotide
tatttctcaaagagcg

SEQ ID NO: 1230 - DNA, 16 bp, Artificial sequence
  Synthetic oligonucleotide
ttcttccaaaaaaacc

SEQ ID NO: 1231 - DNA, 16 bp, Artificial sequence
  Synthetic oligonucleotide
cccttcttccaaaaaa

SEQ ID NO: 1232 - DNA, 16 bp, Artificial sequence
  Synthetic oligonucleotide
tgccccttcttccaaa

SEQ ID NO: 1233 - DNA, 16 bp, Artificial sequence
  Synthetic oligonucleotide
tacctgccccttcttc

SEQ ID NO: 1234 - DNA, 16 bp, Artificial sequence
  Synthetic oligonucleotide
tcatacctgccccttc

SEQ ID NO: 1235 - DNA, 16 bp, Artificial sequence
  Synthetic oligonucleotide
cgatcatacctgcccc

SEQ ID NO: 1236 - DNA, 16 bp, Artificial sequence
  Synthetic oligonucleotide
tgccgatcatacctgc

SEQ ID NO: 1237 - DNA, 16 bp, Artificial sequence
  Synthetic oligonucleotide
tcctgccgatcatacc

SEQ ID NO: 1238 - DNA, 16 bp, Artificial sequence
  Synthetic oligonucleotide
ggtgtcctgccgatca

SEQ ID NO: 1239 - DNA, 16 bp, Artificial sequence
  Synthetic oligonucleotide
tatcagggtgtcctgc

SEQ ID NO: 1240 - DNA, 16 bp, Artificial sequence
  Synthetic oligonucleotide
ccccttcatacactgt

SEQ ID NO: 1241 - DNA, 16 bp, Artificial sequence
  Synthetic oligonucleotide
gccccccttcatacac

SEQ ID NO: 1242 - DNA, 16 bp, Artificial sequence
  Synthetic oligonucleotide
gaccgccccccttcat

SEQ ID NO: 1243 - DNA, 16 bp, Artificial sequence
  Synthetic oligonucleotide
gatgaccgcccccctt

SEQ ID NO: 1244 - DNA, 16 bp, Artificial sequence
  Synthetic oligonucleotide
aatgatgaccgccccc

SEQ ID NO: 1245 - DNA, 16 bp, Artificial sequence
  Synthetic oligonucleotide
tgaaatgatgaccgcc

SEQ ID NO: 1246 - DNA, 16 bp, Artificial sequence
  Synthetic oligonucleotide
aagtgaaatgatgacc

SEQ ID NO: 1247 - DNA, 16 bp, Artificial sequence
  Synthetic oligonucleotide
gacaagtgaaatgatg

SEQ ID NO: 1248 - DNA, 16 bp, Artificial sequence
  Synthetic oligonucleotide
cctgacaagtgaaatg

SEQ ID NO: 1249 - DNA, 16 bp, Artificial sequence
  Synthetic oligonucleotide
actcctgacaagtgaa

SEQ ID NO: 1250 - DNA, 16 bp, Artificial sequence
  Synthetic oligonucleotide
acacagccgcacactc

SEQ ID NO: 1251 - DNA, 16 bp, Artificial sequence
  Synthetic oligonucleotide
gcacacacagccgcac

SEQ ID NO: 1252 - DNA, 16 bp, Artificial sequence
  Synthetic oligonucleotide
cgtgcacacacagccg

SEQ ID NO: 1253 - DNA, 16 bp, Artificial sequence
  Synthetic oligonucleotide
cgctcctgcacacgcg

SEQ ID NO: 1254 - DNA, 16 bp, Artificial sequence
  Synthetic oligonucleotide
tgccgctcctgcacac

SEQ ID NO: 1255 - DNA, 16 bp, Artificial sequence
  Synthetic oligonucleotide
ccatctgccgctcctg

SEQ ID NO: 1256 - DNA, 16 bp, Artificial sequence
  Synthetic oligonucleotide
tccccatctgccgctc

SEQ ID NO: 1257 - DNA, 16 bp, Artificial sequence
  Synthetic oligonucleotide
cgttgtctccccatct

SEQ ID NO: 1258 - DNA, 16 bp, Artificial sequence
  Synthetic oligonucleotide
caaaacaaagagcacg

SEQ ID NO: 1259 - DNA, 16 bp, Artificial sequence
  Synthetic oligonucleotide
ataagagacacaaaac

SEQ ID NO: 1260 - DNA, 16 bp, Artificial sequence
  Synthetic oligonucleotide
tgggactgcaaacctc

SEQ ID NO: 1261 - DNA, 16 bp, Artificial sequence
  Synthetic oligonucleotide
cttgggactgcaaacc

SEQ ID NO: 1262 - DNA, 16 bp, Artificial sequence
  Synthetic oligonucleotide
cgcttgggactgcaaa

SEQ ID NO: 1263 - DNA, 16 bp, Artificial sequence
  Synthetic oligonucleotide
ccgcttgggactgcaa

SEQ ID NO: 1264 - DNA, 16 bp, Artificial sequence
  Synthetic oligonucleotide
accgcttgggactgca

SEQ ID NO: 1265 - DNA, 16 bp, Artificial sequence
  Synthetic oligonucleotide
agacaccgcttgggac

SEQ ID NO: 1266 - DNA, 16 bp, Artificial sequence
  Synthetic oligonucleotide
ggagagacaccgcttg

SEQ ID NO: 1267 - DNA, 16 bp, Artificial sequence
  Synthetic oligonucleotide
gcaggagagacaccgc

SEQ ID NO: 1268 - DNA, 16 bp, Artificial sequence
  Synthetic oligonucleotide
tgcctctgccccactg

SEQ ID NO: 1269 - DNA, 16 bp, Artificial sequence
  Synthetic oligonucleotide
aggtactgcctctgcc

SEQ ID NO: 1270 - DNA, 16 bp, Artificial sequence
  Synthetic oligonucleotide
agccgtgctcctggca

SEQ ID NO: 1271 - DNA, 16 bp, Artificial sequence
  Synthetic oligonucleotide
cagagccgtgctcctg

SEQ ID NO: 1272 - DNA, 16 bp, Artificial sequence
  Synthetic oligonucleotide
ggacagagccgtgctc

SEQ ID NO: 1273 - DNA, 16 bp, Artificial sequence
  Synthetic oligonucleotide
ggctttcccaggctgg

SEQ ID NO: 1274 - DNA, 16 bp, Artificial sequence
  Synthetic oligonucleotide
ttgatgagggagagga

SEQ ID NO: 1275 - DNA, 16 bp, Artificial sequence
  Synthetic oligonucleotide
tccttgatgagggaga

SEQ ID NO: 1276 - DNA, 16 bp, Artificial sequence
  Synthetic oligonucleotide
gcccgtgtccttgatg

SEQ ID NO: 1277 - DNA, 16 bp, Artificial sequence
  Synthetic oligonucleotide
acaggcccgtgtcctt

SEQ ID NO: 1278 - DNA, 16 bp, Artificial sequence
  Synthetic oligonucleotide
tggacaggcccgtgtc

SEQ ID NO: 1279 - DNA, 16 bp, Artificial sequence
  Synthetic oligonucleotide
ctgtggacaggcccgt

SEQ ID NO: 1280 - DNA, 16 bp, Artificial sequence
  Synthetic oligonucleotide
tggttctggttcggcc

SEQ ID NO: 1281 - DNA, 16 bp, Artificial sequence
  Synthetic oligonucleotide
taattggttctggttc

SEQ ID NO: 1282 - DNA, 16 bp, Artificial sequence
  Synthetic oligonucleotide
aaataattggttctgg

SEQ ID NO: 1283 - DNA, 16 bp, Artificial sequence
  Synthetic oligonucleotide
tgaaaataattggttc

SEQ ID NO: 1284 - DNA, 16 bp, Artificial sequence
  Synthetic oligonucleotide
ggatgaaaataattgg

SEQ ID NO: 1285 - DNA, 16 bp, Artificial sequence
  Synthetic oligonucleotide
gacaaggatgaaaata

SEQ ID NO: 1286 - DNA, 16 bp, Artificial sequence
  Synthetic oligonucleotide
ataagacaaggatgaa

SEQ ID NO: 1287 - DNA, 16 bp, Artificial sequence
  Synthetic oligonucleotide
agggaataagacaagg

SEQ ID NO: 1288 - DNA, 16 bp, Artificial sequence
  Synthetic oligonucleotide
ggaagggaataagaca

SEQ ID NO: 1289 - DNA, 16 bp, Artificial sequence
  Synthetic oligonucleotide
gcaggaagggaataag

SEQ ID NO: 1290 - DNA, 16 bp, Artificial sequence
  Synthetic oligonucleotide
ggaagcccatctcagg

SEQ ID NO: 1291 - DNA, 16 bp, Artificial sequence
  Synthetic oligonucleotide
cttgggaagcccatct

SEQ ID NO: 1292 - DNA, 16 bp, Artificial sequence
  Synthetic oligonucleotide
gcccttgggaagccca

SEQ ID NO: 1293 - DNA, 16 bp, Artificial sequence
  Synthetic oligonucleotide
ggcagcccttgggaag

SEQ ID NO: 1294 - DNA, 16 bp, Artificial sequence
  Synthetic oligonucleotide
ccccggcagcccttgg

SEQ ID NO: 1295 - DNA, 16 bp, Artificial sequence
  Synthetic oligonucleotide
gctgccccggcagccc

SEQ ID NO: 1296 - DNA, 16 bp, Artificial sequence
  Synthetic oligonucleotide
agcaatactgtgaggg

SEQ ID NO: 1297 - DNA, 16 bp, Artificial sequence
  Synthetic oligonucleotide
gtgagcaatactgtga

SEQ ID NO: 1298 - DNA, 16 bp, Artificial sequence
  Synthetic oligonucleotide
actgggtgagcaatac

SEQ ID NO: 1299 - DNA, 16 bp, Artificial sequence
  Synthetic oligonucleotide
ggcactgggtgagcaa

SEQ ID NO: 1300 - DNA, 16 bp, Artificial sequence
  Synthetic oligonucleotide
ccgggaaaaacctgat

SEQ ID NO: 1301 - DNA, 16 bp, Artificial sequence
  Synthetic oligonucleotide
agtccgggaaaaacct

SEQ ID NO: 1302 - DNA, 16 bp, Artificial sequence
  Synthetic oligonucleotide
ctaagtccgggaaaaa

SEQ ID NO: 1303 - DNA, 16 bp, Artificial sequence
  Synthetic oligonucleotide
ttttctaagtccggga

SEQ ID NO: 1304 - DNA, 16 bp, Artificial sequence
  Synthetic oligonucleotide
ctggttttctaagtcc

SEQ ID NO: 1305 - DNA, 16 bp, Artificial sequence
  Synthetic oligonucleotide
ctgagctggttttcta

SEQ ID NO: 1306 - DNA, 16 bp, Artificial sequence
  Synthetic oligonucleotide
cagtgctgagctggtt

SEQ ID NO: 1307 - DNA, 16 bp, Artificial sequence
  Synthetic oligonucleotide
aggcagtgctgagctg

SEQ ID NO: 1308 - DNA, 16 bp, Artificial sequence
  Synthetic oligonucleotide
agcaggcagtgctgag

SEQ ID NO: 1309 - DNA, 16 bp, Artificial sequence
  Synthetic oligonucleotide
gggagcaggcagtgct

SEQ ID NO: 1310 - DNA, 16 bp, Artificial sequence
  Synthetic oligonucleotide
cttgctggcctaatag

SEQ ID NO: 1311 - DNA, 16 bp, Artificial sequence
  Synthetic oligonucleotide
ccgcttgctggcctaa

SEQ ID NO: 1312 - DNA, 16 bp, Artificial sequence
  Synthetic oligonucleotide
tccccgcttgctggcc

SEQ ID NO: 1313 - DNA, 16 bp, Artificial sequence
  Synthetic oligonucleotide
gacatccccgcttgct

SEQ ID NO: 1314 - DNA, 16 bp, Artificial sequence
  Synthetic oligonucleotide
agggacatccccgctt

SEQ ID NO: 1315 - DNA, 16 bp, Artificial sequence
  Synthetic oligonucleotide
cccagggacatccccg

SEQ ID NO: 1316 - DNA, 16 bp, Artificial sequence
  Synthetic oligonucleotide
cctcccagggacatcc

SEQ ID NO: 1317 - DNA, 16 bp, Artificial sequence
  Synthetic oligonucleotide
gtccctcccagggaca

SEQ ID NO: 1318 - DNA, 16 bp, Artificial sequence
  Synthetic oligonucleotide
catgtccctcccaggg

SEQ ID NO: 1319 - DNA, 16 bp, Artificial sequence
  Synthetic oligonucleotide
aagcatgtccctccca

SEQ ID NO: 1320 - DNA, 16 bp, Artificial sequence
  Synthetic oligonucleotide
tgggttatgacggacc

SEQ ID NO: 1321 - DNA, 16 bp, Artificial sequence
  Synthetic oligonucleotide
ttgggttatgacggac

SEQ ID NO: 1322 - DNA, 16 bp, Artificial sequence
  Synthetic oligonucleotide
cttgggttatgacgga

SEQ ID NO: 1323 - DNA, 16 bp, Artificial sequence
  Synthetic oligonucleotide
taccttgggttatgac

SEQ ID NO: 1324 - DNA, 16 bp, Artificial sequence
  Synthetic oligonucleotide
gtaccttgggttatga

SEQ ID NO: 1325 - DNA, 16 bp, Artificial sequence
  Synthetic oligonucleotide
tggtaccttgggttat

SEQ ID NO: 1326 - DNA, 16 bp, Artificial sequence
  Synthetic oligonucleotide
ggatggtaccttgggt

SEQ ID NO: 1327 - DNA, 16 bp, Artificial sequence
  Synthetic oligonucleotide
ctaggatggtaccttg

SEQ ID NO: 1328 - DNA, 16 bp, Artificial sequence
  Synthetic oligonucleotide
agcctaggatggtacc

SEQ ID NO: 1329 - DNA, 16 bp, Artificial sequence
  Synthetic oligonucleotide
tgtcagcctaggatgg

SEQ ID NO: 1330 - DNA, 16 bp, Artificial sequence
  Synthetic oligonucleotide
aagtatcatacgagtg

SEQ ID NO: 1331 - DNA, 16 bp, Artificial sequence
  Synthetic oligonucleotide
tcgaagtatcatacga

SEQ ID NO: 1332 - DNA, 16 bp, Artificial sequence
  Synthetic oligonucleotide
gtgtcgaagtatcata

SEQ ID NO: 1333 - DNA, 16 bp, Artificial sequence
  Synthetic oligonucleotide
aacagtgtcgaagtat

SEQ ID NO: 1334 - DNA, 16 bp, Artificial sequence
  Synthetic oligonucleotide
aagaacagtgtcgaag

SEQ ID NO: 1335 - DNA, 16 bp, Artificial sequence
  Synthetic oligonucleotide
gctaagaacagtgtcg

SEQ ID NO: 1336 - DNA, 16 bp, Artificial sequence
  Synthetic oligonucleotide
ttgagctaagaacagt

SEQ ID NO: 1337 - DNA, 16 bp, Artificial sequence
  Synthetic oligonucleotide
tcattgagctaagaac

SEQ ID NO: 1338 - DNA, 16 bp, Artificial sequence
  Synthetic oligonucleotide
tgctcattgagctaag

SEQ ID NO: 1339 - DNA, 16 bp, Artificial sequence
  Synthetic oligonucleotide
aacatgctcattgagc

SEQ ID NO: 1340 - DNA, 16 bp, Artificial sequence
  Synthetic oligonucleotide
ctttgtagttagaaaa

SEQ ID NO: 1341 - DNA, 16 bp, Artificial sequence
  Synthetic oligonucleotide
aacctttgtagttaga

SEQ ID NO: 1342 - DNA, 16 bp, Artificial sequence
  Synthetic oligonucleotide
ttaaacctttgtagtt

SEQ ID NO: 1343 - DNA, 16 bp, Artificial sequence
  Synthetic oligonucleotide
catttaaacctttgta

SEQ ID NO: 1344 - DNA, 16 bp, Artificial sequence
  Synthetic oligonucleotide
gttcatttaaaccttt

SEQ ID NO: 1345 - DNA, 16 bp, Artificial sequence
  Synthetic oligonucleotide
cttgttcatttaaacc

SEQ ID NO: 1346 - DNA, 16 bp, Artificial sequence
  Synthetic oligonucleotide
cttctcttgttcattt

SEQ ID NO: 1347 - DNA, 16 bp, Artificial sequence
  Synthetic oligonucleotide
tgcttctcttgttcat

SEQ ID NO: 1348 - DNA, 16 bp, Artificial sequence
  Synthetic oligonucleotide
aatgcttctcttgttc

SEQ ID NO: 1349 - DNA, 16 bp, Artificial sequence
  Synthetic oligonucleotide
agaatgcttctcttgt

SEQ ID NO: 1350 - DNA, 16 bp, Artificial sequence
  Synthetic oligonucleotide
ctcaaagcactacaat

SEQ ID NO: 1351 - DNA, 16 bp, Artificial sequence
  Synthetic oligonucleotide
tctctcaaagcactac

SEQ ID NO: 1352 - DNA, 16 bp, Artificial sequence
  Synthetic oligonucleotide
gtcctttctctctcaa

SEQ ID NO: 1353 - DNA, 16 bp, Artificial sequence
  Synthetic oligonucleotide
ggagtcctttctctct

SEQ ID NO: 1354 - DNA, 16 bp, Artificial sequence
  Synthetic oligonucleotide
tcaggagtcctttctc

SEQ ID NO: 1355 - DNA, 16 bp, Artificial sequence
  Synthetic oligonucleotide
ttttcaggagtccttt

SEQ ID NO: 1356 - DNA, 16 bp, Artificial sequence
  Synthetic oligonucleotide
tttttttcaggagtcc

SEQ ID NO: 1357 - DNA, 16 bp, Artificial sequence
  Synthetic oligonucleotide
ggttttttttcaggag

SEQ ID NO: 1358 - DNA, 16 bp, Artificial sequence
  Synthetic oligonucleotide
ctcaggttttttttca

SEQ ID NO: 1359 - DNA, 16 bp, Artificial sequence
  Synthetic oligonucleotide
taaatctcaggttttt

SEQ ID NO: 1360 - DNA, 16 bp, Artificial sequence
  Synthetic oligonucleotide
tgtttatacacattgc

SEQ ID NO: 1361 - DNA, 16 bp, Artificial sequence
  Synthetic oligonucleotide
ttcttgtttatacaca

SEQ ID NO: 1362 - DNA, 16 bp, Artificial sequence
  Synthetic oligonucleotide
gtgcatcttttcttta

SEQ ID NO: 1363 - DNA, 16 bp, Artificial sequence
  Synthetic oligonucleotide
aaagtgcatcttttct

SEQ ID NO: 1364 - DNA, 16 bp, Artificial sequence
  Synthetic oligonucleotide
agcaaagtgcatcttt

SEQ ID NO: 1365 - DNA, 16 bp, Artificial sequence
  Synthetic oligonucleotide
taaagcaaagtgcatc

SEQ ID NO: 1366 - DNA, 16 bp, Artificial sequence
  Synthetic oligonucleotide
tattaaagcaaagtgc

SEQ ID NO: 1367 - DNA, 16 bp, Artificial sequence
  Synthetic oligonucleotide
gcatttatattaaagc

SEQ ID NO: 1368 - DNA, 16 bp, Artificial sequence
  Synthetic oligonucleotide
gttatttgcatttata

SEQ ID NO: 1369 - DNA, 16 bp, Artificial sequence
  Synthetic oligonucleotide
catttgttatttgcat

SEQ ID NO: 1370 - DNA, 16 bp, Artificial sequence
  Synthetic oligonucleotide
acccatagaaaaaaac

SEQ ID NO: 1371 - DNA, 16 bp, Artificial sequence
  Synthetic oligonucleotide
aacacccatagaaaaa

SEQ ID NO: 1372 - DNA, 16 bp, Artificial sequence
  Synthetic oligonucleotide
gataacacccatagaa

SEQ ID NO: 1373 - DNA, 16 bp, Artificial sequence
  Synthetic oligonucleotide
ggtgataacacccata

SEQ ID NO: 1374 - DNA, 16 bp, Artificial sequence
  Synthetic oligonucleotide
gctaggtgataacacc

SEQ ID NO: 1375 - DNA, 16 bp, Artificial sequence
  Synthetic oligonucleotide
tcagctaggtgataac

SEQ ID NO: 1376 - DNA, 16 bp, Artificial sequence
  Synthetic oligonucleotide
cattcagctaggtgat

SEQ ID NO: 1377 - DNA, 16 bp, Artificial sequence
  Synthetic oligonucleotide
aaacattcagctaggt

SEQ ID NO: 1378 - DNA, 16 bp, Artificial sequence
  Synthetic oligonucleotide
gaaaaacattcagcta

SEQ ID NO: 1379 - DNA, 16 bp, Artificial sequence
  Synthetic oligonucleotide
actcctttagaaaaac

SEQ ID NO: 1380 - DNA, 16 bp, Artificial sequence
  Synthetic oligonucleotide
actctagttcgcagag

SEQ ID NO: 1381 - DNA, 16 bp, Artificial sequence
  Synthetic oligonucleotide
gagactctagttcgca

SEQ ID NO: 1382 - DNA, 16 bp, Artificial sequence
  Synthetic oligonucleotide
atctgaaagcccccca

SEQ ID NO: 1383 - DNA, 16 bp, Artificial sequence
  Synthetic oligonucleotide
ggaatctgaaagcccc

SEQ ID NO: 1384 - DNA, 16 bp, Artificial sequence
  Synthetic oligonucleotide
ttgggaatctgaaagc

SEQ ID NO: 1385 - DNA, 16 bp, Artificial sequence
  Synthetic oligonucleotide
aagttgggaatctgaa

SEQ ID NO: 1386 - DNA, 16 bp, Artificial sequence
  Synthetic oligonucleotide
ggcctgcgctccggct

SEQ ID NO: 1387 - DNA, 16 bp, Artificial sequence
  Synthetic oligonucleotide
cagtctcccggaggcc

SEQ ID NO: 1388 - DNA, 16 bp, Artificial sequence
  Synthetic oligonucleotide
cgccagtctcccggag

SEQ ID NO: 1389 - DNA, 16 bp, Artificial sequence
  Synthetic oligonucleotide
catgcgccagtctccc

SEQ ID NO: 1390 - DNA, 16 bp, Artificial sequence
  Synthetic oligonucleotide
tggcatgcgccagtct

SEQ ID NO: 1391 - DNA, 16 bp, Artificial sequence
  Synthetic oligonucleotide
tccgtggcatgcgcca

SEQ ID NO: 1392 - DNA, 16 bp, Artificial sequence
  Synthetic oligonucleotide
cgctccgtggcatgcg

SEQ ID NO: 1393 - DNA, 16 bp, Artificial sequence
  Synthetic oligonucleotide
ggcggcggcccgaggg

SEQ ID NO: 1394 - DNA, 16 bp, Artificial sequence
  Synthetic oligonucleotide
agcggcggcggcccga

SEQ ID NO: 1395 - DNA, 16 bp, Artificial sequence
  Synthetic oligonucleotide
aggagcggcggcggcc

SEQ ID NO: 1396 - DNA, 16 bp, Artificial sequence
  Synthetic oligonucleotide
cgcacaccatgaagaa

SEQ ID NO: 1397 - DNA, 16 bp, Artificial sequence
  Synthetic oligonucleotide
ctccgcacaccatgaa

SEQ ID NO: 1398 - DNA, 16 bp, Artificial sequence
  Synthetic oligonucleotide
gacctccgcacaccat

SEQ ID NO: 1399 - DNA, 16 bp, Artificial sequence
  Synthetic oligonucleotide
catgacctccgcacac

SEQ ID NO: 1400 - DNA, 16 bp, Artificial sequence
  Synthetic oligonucleotide
gaacatgacctccgca

SEQ ID NO: 1401 - DNA, 16 bp, Artificial sequence
  Synthetic oligonucleotide
agcgaacatgacctcc

SEQ ID NO: 1402 - DNA, 16 bp, Artificial sequence
  Synthetic oligonucleotide
aaggagcgaacatgac

SEQ ID NO: 1403 - DNA, 16 bp, Artificial sequence
  Synthetic oligonucleotide
gctaaggagcgaacat

SEQ ID NO: 1404 - DNA, 16 bp, Artificial sequence
  Synthetic oligonucleotide
gcctgctaaggagcga

SEQ ID NO: 1405 - DNA, 16 bp, Artificial sequence
  Synthetic oligonucleotide
cgtttgcctgctaagg

SEQ ID NO: 1406 - DNA, 16 bp, Artificial sequence
  Synthetic oligonucleotide
gccgggcgcacggctc

SEQ ID NO: 1407 - DNA, 16 bp, Artificial sequence
  Synthetic oligonucleotide
gtcctcgccgccgggc

SEQ ID NO: 1408 - DNA, 16 bp, Artificial sequence
  Synthetic oligonucleotide
tgcgccctcctcctcg

SEQ ID NO: 1409 - DNA, 16 bp, Artificial sequence
  Synthetic oligonucleotide
tccccctgcgccctcc

SEQ ID NO: 1410 - DNA, 16 bp, Artificial sequence
  Synthetic oligonucleotide
acctccccctgcgccc

SEQ ID NO: 1411 - DNA, 16 bp, Artificial sequence
  Synthetic oligonucleotide
agctcgcctcctcctc

SEQ ID NO: 1412 - DNA, 16 bp, Artificial sequence
  Synthetic oligonucleotide
cgcagctcgcctcctc

SEQ ID NO: 1413 - DNA, 16 bp, Artificial sequence
  Synthetic oligonucleotide
ccccgcagctcgcctc

SEQ ID NO: 1414 - DNA, 16 bp, Artificial sequence
  Synthetic oligonucleotide
cttctccccgcagctc

SEQ ID NO: 1415 - DNA, 16 bp, Artificial sequence
  Synthetic oligonucleotide
ccccttctccccgcag

SEQ ID NO: 1416 - DNA, 16 bp, Artificial sequence
  Synthetic oligonucleotide
gccgccaccggcccca

SEQ ID NO: 1417 - DNA, 16 bp, Artificial sequence
  Synthetic oligonucleotide
ggccgccgccaccggc

SEQ ID NO: 1418 - DNA, 16 bp, Artificial sequence
  Synthetic oligonucleotide
gcccgggccgccgcca

SEQ ID NO: 1419 - DNA, 16 bp, Artificial sequence
  Synthetic oligonucleotide
cctgcccgggccgccg

SEQ ID NO: 1420 - DNA, 16 bp, Artificial sequence
  Synthetic oligonucleotide
agccctgcccgggccg

SEQ ID NO: 1421 - DNA, 16 bp, Artificial sequence
  Synthetic oligonucleotide
atccagccctgcccgg

SEQ ID NO: 1422 - DNA, 16 bp, Artificial sequence
  Synthetic oligonucleotide
agcatccagccctgcc

SEQ ID NO: 1423 - DNA, 16 bp, Artificial sequence
  Synthetic oligonucleotide
ggcagcatccagccct

SEQ ID NO: 1424 - DNA, 16 bp, Artificial sequence
  Synthetic oligonucleotide
gcccaggcagcatcca

SEQ ID NO: 1425 - DNA, 16 bp, Artificial sequence
  Synthetic oligonucleotide
cttgcccaggcagcat

SEQ ID NO: 1426 - DNA, 16 bp, Artificial sequence
  Synthetic oligonucleotide
cgcggctggcgggtgg

SEQ ID NO: 1427 - DNA, 16 bp, Artificial sequence
  Synthetic oligonucleotide
gcccgcggctggcggg

SEQ ID NO: 1428 - DNA, 16 bp, Artificial sequence
  Synthetic oligonucleotide
cccccggccgcgccgg

SEQ ID NO: 1429 - DNA, 16 bp, Artificial sequence
  Synthetic oligonucleotide
gcgcccccggccgcgc

SEQ ID NO: 1430 - DNA, 16 bp, Artificial sequence
  Synthetic oligonucleotide
cagatccgcctcggcg

SEQ ID NO: 1431 - DNA, 16 bp, Artificial sequence
  Synthetic oligonucleotide
cttcagatccgcctcg

SEQ ID NO: 1432 - DNA, 16 bp, Artificial sequence
  Synthetic oligonucleotide
cgccttcagatccgcc

SEQ ID NO: 1433 - DNA, 16 bp, Artificial sequence
  Synthetic oligonucleotide
ttgagcaccgagtgcg

SEQ ID NO: 1434 - DNA, 16 bp, Artificial sequence
  Synthetic oligonucleotide
ttcttgagcaccgagt

SEQ ID NO: 1435 - DNA, 16 bp, Artificial sequence
  Synthetic oligonucleotide
cttcagtttcttgagc

SEQ ID NO: 1436 - DNA, 16 bp, Artificial sequence
  Synthetic oligonucleotide
agcaggaggcacgcgg

SEQ ID NO: 1437 - DNA, 16 bp, Artificial sequence
  Synthetic oligonucleotide
ggcagcaggaggcacg

SEQ ID NO: 1438 - DNA, 16 bp, Artificial sequence
  Synthetic oligonucleotide
ccgggcagcaggaggc

SEQ ID NO: 1439 - DNA, 16 bp, Artificial sequence
  Synthetic oligonucleotide
cggccgggcagcagga

SEQ ID NO: 1440 - DNA, 16 bp, Artificial sequence
  Synthetic oligonucleotide
gtccaggcggccgggc

SEQ ID NO: 1441 - DNA, 16 bp, Artificial sequence
  Synthetic oligonucleotide
tgcagtccaggcggcc

SEQ ID NO: 1442 - DNA, 16 bp, Artificial sequence
  Synthetic oligonucleotide
agcctgcagtccaggc

SEQ ID NO: 1443 - DNA, 16 bp, Artificial sequence
  Synthetic oligonucleotide
gcccagcctgcagtcc

SEQ ID NO: 1444 - DNA, 16 bp, Artificial sequence
  Synthetic oligonucleotide
cgcccccgggcccagc

SEQ ID NO: 1445 - DNA, 16 bp, Artificial sequence
  Synthetic oligonucleotide
gcgcaggctgcgcgcc

SEQ ID NO: 1446 - DNA, 16 bp, Artificial sequence
  Synthetic oligonucleotide
ctgaacactttgcaca

SEQ ID NO: 1447 - DNA, 16 bp, Artificial sequence
  Synthetic oligonucleotide
cacctgaacactttgc

SEQ ID NO: 1448 - DNA, 16 bp, Artificial sequence
  Synthetic oligonucleotide
ggccacctgaacactt

SEQ ID NO: 1449 - DNA, 16 bp, Artificial sequence
  Synthetic oligonucleotide
tccggccacctgaaca

SEQ ID NO: 1450 - DNA, 16 bp, Artificial sequence
  Synthetic oligonucleotide
gagatccggccacctg

SEQ ID NO: 1451 - DNA, 16 bp, Artificial sequence
  Synthetic oligonucleotide
cctgagatccggccac

SEQ ID NO: 1452 - DNA, 16 bp, Artificial sequence
  Synthetic oligonucleotide
aatgcctgagatccgg

SEQ ID NO: 1453 - DNA, 16 bp, Artificial sequence
  Synthetic oligonucleotide
aggaatgcctgagatc

SEQ ID NO: 1454 - DNA, 16 bp, Artificial sequence
  Synthetic oligonucleotide
ccgaggaatgcctgag

SEQ ID NO: 1455 - DNA, 16 bp, Artificial sequence
  Synthetic oligonucleotide
cttccgaggaatgcct

SEQ ID NO: 1456 - DNA, 16 bp, Artificial sequence
  Synthetic oligonucleotide
cgtaagattcacagca

SEQ ID NO: 1457 - DNA, 16 bp, Artificial sequence
  Synthetic oligonucleotide
tcccgtaagattcaca

SEQ ID NO: 1458 - DNA, 16 bp, Artificial sequence
  Synthetic oligonucleotide
atcttcccgtaagatt

SEQ ID NO: 1459 - DNA, 16 bp, Artificial sequence
  Synthetic oligonucleotide
gttgatcttcccgtaa

SEQ ID NO: 1460 - DNA, 16 bp, Artificial sequence
  Synthetic oligonucleotide
agcacaccagctcggg

SEQ ID NO: 1461 - DNA, 16 bp, Artificial sequence
  Synthetic oligonucleotide
tgcagcacaccagctc

SEQ ID NO: 1462 - DNA, 16 bp, Artificial sequence
  Synthetic oligonucleotide
cggctaaggtgatggg

SEQ ID NO: 1463 - DNA, 16 bp, Artificial sequence
  Synthetic oligonucleotide
gagtcggctaaggtga

SEQ ID NO: 1464 - DNA, 16 bp, Artificial sequence
  Synthetic oligonucleotide
gcagagtcggctaagg

SEQ ID NO: 1465 - DNA, 16 bp, Artificial sequence
  Synthetic oligonucleotide
gttcgcagagtcggct

SEQ ID NO: 1466 - DNA, 16 bp, Artificial sequence
  Synthetic oligonucleotide
atgcacactctcccag

SEQ ID NO: 1467 - DNA, 16 bp, Artificial sequence
  Synthetic oligonucleotide
gtatgcacactctccc

SEQ ID NO: 1468 - DNA, 16 bp, Artificial sequence
  Synthetic oligonucleotide
ggtatgcacactctcc

SEQ ID NO: 1469 - DNA, 16 bp, Artificial sequence
  Synthetic oligonucleotide
agggtatgcacactct

SEQ ID NO: 1470 - DNA, 16 bp, Artificial sequence
  Synthetic oligonucleotide
gggaatgccctttgag

SEQ ID NO: 1471 - DNA, 16 bp, Artificial sequence
  Synthetic oligonucleotide
agaaaacctggaaggg

SEQ ID NO: 1472 - DNA, 16 bp, Artificial sequence
  Synthetic oligonucleotide
ccgtagaccccttcgg

SEQ ID NO: 1473 - DNA, 16 bp, Artificial sequence
  Synthetic oligonucleotide
tgcaggagcagtgccc

SEQ ID NO: 1474 - DNA, 16 bp, Artificial sequence
  Synthetic oligonucleotide
actgcaggagcagtgc

SEQ ID NO: 1475 - DNA, 16 bp, Artificial sequence
  Synthetic oligonucleotide
gtctttccgggtgcgg

SEQ ID NO: 1476 - DNA, 16 bp, Artificial sequence
  Synthetic oligonucleotide
attctccgtatttact

SEQ ID NO: 1477 - DNA, 16 bp, Artificial sequence
  Synthetic oligonucleotide
caaaggtgcgcggcca

SEQ ID NO: 1478 - DNA, 16 bp, Artificial sequence
  Synthetic oligonucleotide
ctccaaaggtgcgcgg

SEQ ID NO: 1479 - DNA, 16 bp, Artificial sequence
  Synthetic oligonucleotide
aaactccaaaggtgcg

SEQ ID NO: 1480 - DNA, 16 bp, Artificial sequence
  Synthetic oligonucleotide
caaaactccaaaggtg

SEQ ID NO: 1481 - DNA, 16 bp, Artificial sequence
  Synthetic oligonucleotide
ccaaaactccaaaggt

SEQ ID NO: 1482 - DNA, 16 bp, Artificial sequence
  Synthetic oligonucleotide
ccccaaaactccaaag

SEQ ID NO: 1483 - DNA, 16 bp, Artificial sequence
  Synthetic oligonucleotide
gccccaaaactccaaa

SEQ ID NO: 1484 - DNA, 16 bp, Artificial sequence
  Synthetic oligonucleotide
tgccccaaaactccaa

SEQ ID NO: 1485 - DNA, 16 bp, Artificial sequence
  Synthetic oligonucleotide
ttgccccaaaactcca

SEQ ID NO: 1486 - DNA, 16 bp, Artificial sequence
  Synthetic oligonucleotide
tttgccccaaaactcc

SEQ ID NO: 1487 - DNA, 16 bp, Artificial sequence
  Synthetic oligonucleotide
ataaaaggaaaggagt

SEQ ID NO: 1488 - DNA, 16 bp, Artificial sequence
  Synthetic oligonucleotide
agcgcactcgggagat

SEQ ID NO: 1489 - DNA, 16 bp, Artificial sequence
  Synthetic oligonucleotide
attcctagcgcactcg

SEQ ID NO: 1490 - DNA, 16 bp, Artificial sequence
  Synthetic oligonucleotide
tttagctgtcagataa

SEQ ID NO: 1491 - DNA, 16 bp, Artificial sequence
  Synthetic oligonucleotide
gcggtgattgccttga

SEQ ID NO: 1492 - DNA, 16 bp, Artificial sequence
  Synthetic oligonucleotide
tcttttagcccaactg

SEQ ID NO: 1493 - DNA, 16 bp, Artificial sequence
  Synthetic oligonucleotide
atctactcaccagttg

SEQ ID NO: 1494 - DNA, 16 bp, Artificial sequence
  Synthetic oligonucleotide
aggaaacctagaacca

SEQ ID NO: 1495 - DNA, 16 bp, Artificial sequence
  Synthetic oligonucleotide
gaaaaattcaccaaac

SEQ ID NO: 1496 - DNA, 16 bp, Artificial sequence
  Synthetic oligonucleotide
cacaacagaaaaattc

SEQ ID NO: 1497 - DNA, 16 bp, Artificial sequence
  Synthetic oligonucleotide
agtctccgagttatcc

SEQ ID NO: 1498 - DNA, 16 bp, Artificial sequence
  Synthetic oligonucleotide
ctaagtctccgagtta

SEQ ID NO: 1499 - DNA, 16 bp, Artificial sequence
  Synthetic oligonucleotide
actcactaagtctccg

SEQ ID NO: 1500 - DNA, 16 bp, Artificial sequence
  Synthetic oligonucleotide
ggcactcactaagtct

SEQ ID NO: 1501 - DNA, 16 bp, Artificial sequence
  Synthetic oligonucleotide
ccctttccattattcc

SEQ ID NO: 1502 - DNA, 16 bp, Artificial sequence
  Synthetic oligonucleotide
cccatctatcgaatca

SEQ ID NO: 1503 - DNA, 16 bp, Artificial sequence
  Synthetic oligonucleotide
aaccgtcttcccatct

SEQ ID NO: 1504 - DNA, 16 bp, Artificial sequence
  Synthetic oligonucleotide
ttgcacctttttaaac

SEQ ID NO: 1505 - DNA, 16 bp, Artificial sequence
  Synthetic oligonucleotide
gcctatacttctgaaa

SEQ ID NO: 1506 - DNA, 16 bp, Artificial sequence
  Synthetic oligonucleotide
gcaggaggaacctacc

SEQ ID NO: 1507 - DNA, 16 bp, Artificial sequence
  Synthetic oligonucleotide
ccaggagctaaatggt

SEQ ID NO: 1508 - DNA, 16 bp, Artificial sequence
  Synthetic oligonucleotide
ttgcagaattccagga

SEQ ID NO: 1509 - DNA, 16 bp, Artificial sequence
  Synthetic oligonucleotide
aaaacgcaggaggcgg

SEQ ID NO: 1510 - DNA, 16 bp, Artificial sequence
  Synthetic oligonucleotide
caaaacttttaattag

SEQ ID NO: 1511 - DNA, 16 bp, Artificial sequence
  Synthetic oligonucleotide
cgccccagcaaaactt

SEQ ID NO: 1512 - DNA, 16 bp, Artificial sequence
  Synthetic oligonucleotide
tattagaccggcacca

SEQ ID NO: 1513 - DNA, 16 bp, Artificial sequence
  Synthetic oligonucleotide
tgctttgcgggccact

SEQ ID NO: 1514 - DNA, 16 bp, Artificial sequence
  Synthetic oligonucleotide
acagagagctgggtat

SEQ ID NO: 1515 - DNA, 16 bp, Artificial sequence
  Synthetic oligonucleotide
ttacaaatacagagag

SEQ ID NO: 1516 - DNA, 16 bp, Artificial sequence
  Synthetic oligonucleotide
tgttacaaatacagag

SEQ ID NO: 1517 - DNA, 16 bp, Artificial sequence
  Synthetic oligonucleotide
tgcaggaaacccaagg

SEQ ID NO: 1518 - DNA, 16 bp, Artificial sequence
  Synthetic oligonucleotide
ttaaatcctgagaaca

SEQ ID NO: 1519 - DNA, 16 bp, Artificial sequence
  Synthetic oligonucleotide
ctacctaatgtcaaca

SEQ ID NO: 1520 - DNA, 16 bp, Artificial sequence
  Synthetic oligonucleotide
tctgtttacacacatt

SEQ ID NO: 1521 - DNA, 16 bp, Artificial sequence
  Synthetic oligonucleotide
tggagaacttttctcc

SEQ ID NO: 1522 - DNA, 16 bp, Artificial sequence
  Synthetic oligonucleotide
ggtgagtaaccagctg

SEQ ID NO: 1523 - DNA, 16 bp, Artificial sequence
  Synthetic oligonucleotide
ttcttacacagcagcg

SEQ ID NO: 1524 - DNA, 16 bp, Artificial sequence
  Synthetic oligonucleotide
attactgatgctaaat

SEQ ID NO: 1525 - DNA, 16 bp, Artificial sequence
  Synthetic oligonucleotide
caaaaccagccccaga

SEQ ID NO: 1526 - DNA, 16 bp, Artificial sequence
  Synthetic oligonucleotide
gccacagcagctggca

SEQ ID NO: 1527 - DNA, 16 bp, Artificial sequence
  Synthetic oligonucleotide
gcttaaattatagcaa

SEQ ID NO: 1528 - DNA, 16 bp, Artificial sequence
  Synthetic oligonucleotide
gtccaggcctcccaga

SEQ ID NO: 1529 - DNA, 16 bp, Artificial sequence
  Synthetic oligonucleotide
gaccacacagtaccta

SEQ ID NO: 1530 - DNA, 16 bp, Artificial sequence
  Synthetic oligonucleotide
cacaagtcacaactgg

SEQ ID NO: 1531 - DNA, 16 bp, Artificial sequence
  Synthetic oligonucleotide
agccacaagtcacaac

SEQ ID NO: 1532 - DNA, 16 bp, Artificial sequence
  Synthetic oligonucleotide
gacagccacaagtcac

SEQ ID NO: 1533 - DNA, 16 bp, Artificial sequence
  Synthetic oligonucleotide
tgacagccacaagtca

SEQ ID NO: 1534 - DNA, 16 bp, Artificial sequence
  Synthetic oligonucleotide
ttcttgtgggatgtgg

SEQ ID NO: 1535 - DNA, 16 bp, Artificial sequence
  Synthetic oligonucleotide
tgaaacacgggaagca

SEQ ID NO: 1536 - DNA, 16 bp, Artificial sequence
  Synthetic oligonucleotide
tcctcaaacctttcag

SEQ ID NO: 1537 - DNA, 16 bp, Artificial sequence
  Synthetic oligonucleotide
gacctaatctctttca

SEQ ID NO: 1538 - DNA, 16 bp, Artificial sequence
  Synthetic oligonucleotide
atgaatgacctaatct

SEQ ID NO: 1539 - DNA, 16 bp, Artificial sequence
  Synthetic oligonucleotide
gtaaaatgaatgactg

SEQ ID NO: 1540 - DNA, 16 bp, Artificial sequence
  Synthetic oligonucleotide
cagcactgcatcggaa

SEQ ID NO: 1541 - DNA, 16 bp, Artificial sequence
  Synthetic oligonucleotide
aagaacacagcactgc

SEQ ID NO: 1542 - DNA, 16 bp, Artificial sequence
  Synthetic oligonucleotide
aaagaacacagcactg

SEQ ID NO: 1543 - DNA, 16 bp, Artificial sequence
  Synthetic oligonucleotide
aaaagaacacagcact

SEQ ID NO: 1544 - DNA, 16 bp, Artificial sequence
  Synthetic oligonucleotide
acacagcactgccagg

SEQ ID NO: 1545 - DNA, 16 bp, Artificial sequence
  Synthetic oligonucleotide
ttaaagacagaggagc

SEQ ID NO: 1546 - DNA, 16 bp, Artificial sequence
  Synthetic oligonucleotide
tgttaaagacagagga

SEQ ID NO: 1547 - DNA, 16 bp, Artificial sequence
  Synthetic oligonucleotide
gacagaagctctaggc

SEQ ID NO: 1548 - DNA, 16 bp, Artificial sequence
  Synthetic oligonucleotide
gcagacagaagctcta

SEQ ID NO: 1549 - DNA, 16 bp, Artificial sequence
  Synthetic oligonucleotide
tcaccttaggcctgtg

SEQ ID NO: 1550 - DNA, 16 bp, Artificial sequence
  Synthetic oligonucleotide
ctccgcatagacagat

SEQ ID NO: 1551 - DNA, 16 bp, Artificial sequence
  Synthetic oligonucleotide
aaaagctccgcataga

SEQ ID NO: 1552 - DNA, 16 bp, Artificial sequence
  Synthetic oligonucleotide
cacagaaaagctccgc

SEQ ID NO: 1553 - DNA, 16 bp, Artificial sequence
  Synthetic oligonucleotide
agccatacctccatct

SEQ ID NO: 1554 - DNA, 16 bp, Artificial sequence
  Synthetic oligonucleotide
tatcccatggctctca

SEQ ID NO: 1555 - DNA, 16 bp, Artificial sequence
  Synthetic oligonucleotide
caagagtccagcccta

SEQ ID NO: 1556 - DNA, 16 bp, Artificial sequence
  Synthetic oligonucleotide
gtgagctgggctattc

SEQ ID NO: 1557 - DNA, 16 bp, Artificial sequence
  Synthetic oligonucleotide
agccactccccgccac

SEQ ID NO: 1558 - DNA, 16 bp, Artificial sequence
  Synthetic oligonucleotide
cataatgacttatcca

SEQ ID NO: 1559 - DNA, 16 bp, Artificial sequence
  Synthetic oligonucleotide
aaacataatgacttat

SEQ ID NO: 1560 - DNA, 16 bp, Artificial sequence
  Synthetic oligonucleotide
tggaagacacccccac

SEQ ID NO: 1561 - DNA, 16 bp, Artificial sequence
  Synthetic oligonucleotide
tctaaaccattttgat

SEQ ID NO: 1562 - DNA, 16 bp, Artificial sequence
  Synthetic oligonucleotide
ttaaatggtgtatacc

SEQ ID NO: 1563 - DNA, 16 bp, Artificial sequence
  Synthetic oligonucleotide
ggcaggcaggaaatgg

SEQ ID NO: 1564 - DNA, 16 bp, Artificial sequence
  Synthetic oligonucleotide
aaacaatagaggcagg

SEQ ID NO: 1565 - DNA, 16 bp, Artificial sequence
  Synthetic oligonucleotide
atacacttaatcaaac

SEQ ID NO: 1566 - DNA, 16 bp, Artificial sequence
  Synthetic oligonucleotide
aggatacacttaatca

SEQ ID NO: 1567 - DNA, 16 bp, Artificial sequence
  Synthetic oligonucleotide
cccggctaaggaaagg

SEQ ID NO: 1568 - DNA, 16 bp, Artificial sequence
  Synthetic oligonucleotide
ggagagcccggctaag

SEQ ID NO: 1569 - DNA, 16 bp, Artificial sequence
  Synthetic oligonucleotide
actcattagtcccatg

SEQ ID NO: 1570 - DNA, 16 bp, Artificial sequence
  Synthetic oligonucleotide
gcaattaaagcaaaac

SEQ ID NO: 1571 - DNA, 16 bp, Artificial sequence
  Synthetic oligonucleotide
agaaacagtctccaca

SEQ ID NO: 1572 - DNA, 16 bp, Artificial sequence
  Synthetic oligonucleotide
gagaaacagtctccac

SEQ ID NO: 1573 - DNA, 16 bp, Artificial sequence
  Synthetic oligonucleotide
taatgacaattccagc

SEQ ID NO: 1574 - DNA, 16 bp, Artificial sequence
  Synthetic oligonucleotide
gttaatgaggataatg

SEQ ID NO: 1575 - DNA, 16 bp, Artificial sequence
  Synthetic oligonucleotide
tacctttagattgcat

SEQ ID NO: 1576 - DNA, 16 bp, Artificial sequence
  Synthetic oligonucleotide
tcggagtttcctcact

SEQ ID NO: 1577 - DNA, 16 bp, Artificial sequence
  Synthetic oligonucleotide
atcaagggcagaaggc

SEQ ID NO: 1578 - DNA, 16 bp, Artificial sequence
  Synthetic oligonucleotide
aggtttgggttggact

SEQ ID NO: 1579 - DNA, 16 bp, Artificial sequence
  Synthetic oligonucleotide
aaggaggtttgggttg

SEQ ID NO: 1580 - DNA, 16 bp, Artificial sequence
  Synthetic oligonucleotide
gtcaaaggaggtttgg

SEQ ID NO: 1581 - DNA, 16 bp, Artificial sequence
  Synthetic oligonucleotide
cggataccaggtggtt

SEQ ID NO: 1582 - DNA, 16 bp, Artificial sequence
  Synthetic oligonucleotide
gaatttctcttgcatt

SEQ ID NO: 1583 - DNA, 16 bp, Artificial sequence
  Synthetic oligonucleotide
gctcaatgagactggc

SEQ ID NO: 1584 - DNA, 16 bp, Artificial sequence
  Synthetic oligonucleotide
attactcgagtcaggc

SEQ ID NO: 1585 - DNA, 16 bp, Artificial sequence
  Synthetic oligonucleotide
atcattactcgagtca

SEQ ID NO: 1586 - DNA, 16 bp, Artificial sequence
  Synthetic oligonucleotide
ttaatcattactcgag

SEQ ID NO: 1587 - DNA, 16 bp, Artificial sequence
  Synthetic oligonucleotide
cagttaatcattactc

SEQ ID NO: 1588 - DNA, 16 bp, Artificial sequence
  Synthetic oligonucleotide
agccagttaatcatta

SEQ ID NO: 1589 - DNA, 16 bp, Artificial sequence
  Synthetic oligonucleotide
ggcagccagttaatca

SEQ ID NO: 1590 - DNA, 16 bp, Artificial sequence
  Synthetic oligonucleotide
ctccgggcagccagtt

SEQ ID NO: 1591 - DNA, 16 bp, Artificial sequence
  Synthetic oligonucleotide
cccgtctgggctccgg

SEQ ID NO: 1592 - DNA, 16 bp, Artificial sequence
  Synthetic oligonucleotide
tgtcacccgtctgggc

SEQ ID NO: 1593 - DNA, 16 bp, Artificial sequence
  Synthetic oligonucleotide
accttgtcacccgtct

SEQ ID NO: 1594 - DNA, 16 bp, Artificial sequence
  Synthetic oligonucleotide
tattaatggtctgctc

SEQ ID NO: 1595 - DNA, 16 bp, Artificial sequence
  Synthetic oligonucleotide
gattattaatggtctg

SEQ ID NO: 1596 - DNA, 16 bp, Artificial sequence
  Synthetic oligonucleotide
gctgattattaatggt

SEQ ID NO: 1597 - DNA, 16 bp, Artificial sequence
  Synthetic oligonucleotide
tgatgctgattattaa

SEQ ID NO: 1598 - DNA, 16 bp, Artificial sequence
  Synthetic oligonucleotide
ccttgatgctgattat

SEQ ID NO: 1599 - DNA, 16 bp, Artificial sequence
  Synthetic oligonucleotide
cgcggccttgatgctg

SEQ ID NO: 1600 - DNA, 16 bp, Artificial sequence
  Synthetic oligonucleotide
gactcgcggccttgat

SEQ ID NO: 1601 - DNA, 16 bp, Artificial sequence
  Synthetic oligonucleotide
gctgactcgcggcctt

SEQ ID NO: 1602 - DNA, 16 bp, Artificial sequence
  Synthetic oligonucleotide
aaaggctgactcgcgg

SEQ ID NO: 1603 - DNA, 16 bp, Artificial sequence
  Synthetic oligonucleotide
ccaaaaggctgactcg

SEQ ID NO: 1604 - DNA, 16 bp, Artificial sequence
  Synthetic oligonucleotide
gcacgctctaaacagc

SEQ ID NO: 1605 - DNA, 16 bp, Artificial sequence
  Synthetic oligonucleotide
taagcacgctctaaac

SEQ ID NO: 1606 - DNA, 16 bp, Artificial sequence
  Synthetic oligonucleotide
ctttaagcacgctcta

SEQ ID NO: 1607 - DNA, 16 bp, Artificial sequence
  Synthetic oligonucleotide
catctttaagcacgct

SEQ ID NO: 1608 - DNA, 16 bp, Artificial sequence
  Synthetic oligonucleotide
atccatctttaagcac

SEQ ID NO: 1609 - DNA, 16 bp, Artificial sequence
  Synthetic oligonucleotide
caagatccatctttaa

SEQ ID NO: 1610 - DNA, 16 bp, Artificial sequence
  Synthetic oligonucleotide
caccaagatccatctt

SEQ ID NO: 1611 - DNA, 16 bp, Artificial sequence
  Synthetic oligonucleotide
aaacaccaagatccat

SEQ ID NO: 1612 - DNA, 16 bp, Artificial sequence
  Synthetic oligonucleotide
taaaaacaccaagatc

SEQ ID NO: 1613 - DNA, 16 bp, Artificial sequence
  Synthetic oligonucleotide
gtggatttgaaaaggg

SEQ ID NO: 1614 - DNA, 16 bp, Artificial sequence
  Synthetic oligonucleotide
ctttagcaatttcaaa

SEQ ID NO: 1615 - DNA, 16 bp, Artificial sequence
  Synthetic oligonucleotide
gcagaaggccaccccc

SEQ ID NO: 1616 - DNA, 16 bp, Artificial sequence
  Synthetic oligonucleotide
gaatgaagtccagacc

SEQ ID NO: 1617 - DNA, 16 bp, Artificial sequence
  Synthetic oligonucleotide
ttcaacaagttcccta

SEQ ID NO: 1618 - DNA, 16 bp, Artificial sequence
  Synthetic oligonucleotide
tcccaccctggtgctc

SEQ ID NO: 1619 - DNA, 16 bp, Artificial sequence
  Synthetic oligonucleotide
tactgttggcagtgct

SEQ ID NO: 1620 - DNA, 16 bp, Artificial sequence
  Synthetic oligonucleotide
tcctactgttggcagt

SEQ ID NO: 1621 - DNA, 16 bp, Artificial sequence
  Synthetic oligonucleotide
ctcctactgttggcag

SEQ ID NO: 1622 - DNA, 16 bp, Artificial sequence
  Synthetic oligonucleotide
gctcctactgttggca

SEQ ID NO: 1623 - DNA, 16 bp, Artificial sequence
  Synthetic oligonucleotide
agctcctactgttggc

SEQ ID NO: 1624 - DNA, 16 bp, Artificial sequence
  Synthetic oligonucleotide
ttacagctcctactgt

SEQ ID NO: 1625 - DNA, 16 bp, Artificial sequence
  Synthetic oligonucleotide
agggaacaattacagc

SEQ ID NO: 1626 - DNA, 16 bp, Artificial sequence
  Synthetic oligonucleotide
ccccgctagggaacaa

SEQ ID NO: 1627 - DNA, 16 bp, Artificial sequence
  Synthetic oligonucleotide
cagataacagagtata

SEQ ID NO: 1628 - DNA, 16 bp, Artificial sequence
  Synthetic oligonucleotide
agtaaacaataccctc

SEQ ID NO: 1629 - DNA, 16 bp, Artificial sequence
  Synthetic oligonucleotide
gagtaaacaataccct

SEQ ID NO: 1630 - DNA, 16 bp, Artificial sequence
  Synthetic oligonucleotide
ctttgagtaaacaata

SEQ ID NO: 1631 - DNA, 16 bp, Artificial sequence
  Synthetic oligonucleotide
cattagaagctttgag

SEQ ID NO: 1632 - DNA, 16 bp, Artificial sequence
  Synthetic oligonucleotide
ctctaggtccctcttt

SEQ ID NO: 1633 - DNA, 16 bp, Artificial sequence
  Synthetic oligonucleotide
aaaagatgcagttcac

SEQ ID NO: 1634 - DNA, 16 bp, Artificial sequence
  Synthetic oligonucleotide
cagaaaagatgcagtt

SEQ ID NO: 1635 - DNA, 16 bp, Artificial sequence
  Synthetic oligonucleotide
accatctaacaacatc

SEQ ID NO: 1636 - DNA, 16 bp, Artificial sequence
  Synthetic oligonucleotide
aataaaaccatctaac

SEQ ID NO: 1637 - DNA, 16 bp, Artificial sequence
  Synthetic oligonucleotide
aagacaaaccttccga

SEQ ID NO: 1638 - DNA, 16 bp, Artificial sequence
  Synthetic oligonucleotide
tatcaagaagacaaac

SEQ ID NO: 1639 - DNA, 16 bp, Artificial sequence
  Synthetic oligonucleotide
agacaagatgttatca

SEQ ID NO: 1640 - DNA, 16 bp, Artificial sequence
  Synthetic oligonucleotide
gaggaggcactcaggc

SEQ ID NO: 1641 - DNA, 16 bp, Artificial sequence
  Synthetic oligonucleotide
ttcacaggtcacatgg

SEQ ID NO: 1642 - DNA, 16 bp, Artificial sequence
  Synthetic oligonucleotide
aaaaagcccacccatc

SEQ ID NO: 1643 - DNA, 16 bp, Artificial sequence
  Synthetic oligonucleotide
aatatctgtgtctaca

SEQ ID NO: 1644 - DNA, 16 bp, Artificial sequence
  Synthetic oligonucleotide
ctgcagtcttctgaag

SEQ ID NO: 1645 - DNA, 16 bp, Artificial sequence
  Synthetic oligonucleotide
attagtaaatcaagag

SEQ ID NO: 1646 - DNA, 16 bp, Artificial sequence
  Synthetic oligonucleotide
ggaattagtaaatcaa

SEQ ID NO: 1647 - DNA, 16 bp, Artificial sequence
  Synthetic oligonucleotide
gcccattatgaataca

SEQ ID NO: 1648 - DNA, 16 bp, Artificial sequence
  Synthetic oligonucleotide
catcacctcccctcca

SEQ ID NO: 1649 - DNA, 16 bp, Artificial sequence
  Synthetic oligonucleotide
ccaataaagttccctt

SEQ ID NO: 1650 - DNA, 16 bp, Artificial sequence
  Synthetic oligonucleotide
tttacaaaactctctg

SEQ ID NO: 1651 - DNA, 16 bp, Artificial sequence
  Synthetic oligonucleotide
ccatttacaaaactct

SEQ ID NO: 1652 - DNA, 16 bp, Artificial sequence
  Synthetic oligonucleotide
acgatcaacttcttga

SEQ ID NO: 1653 - DNA, 16 bp, Artificial sequence
  Synthetic oligonucleotide
ccccatggaacgatca

SEQ ID NO: 1654 - DNA, 16 bp, Artificial sequence
  Synthetic oligonucleotide
gggagaaactcctcag

SEQ ID NO: 1655 - DNA, 16 bp, Artificial sequence
  Synthetic oligonucleotide
tgtgaaagaggctcag

SEQ ID NO: 1656 - DNA, 16 bp, Artificial sequence
  Synthetic oligonucleotide
aaacagcacacagggc

SEQ ID NO: 1657 - DNA, 16 bp, Artificial sequence
  Synthetic oligonucleotide
ttctaaaaatgtccca

SEQ ID NO: 1658 - DNA, 16 bp, Artificial sequence
  Synthetic oligonucleotide
tacaatctcctggaag

SEQ ID NO: 1659 - DNA, 16 bp, Artificial sequence
  Synthetic oligonucleotide
tgaaagtacaatctcc

SEQ ID NO: 1660 - DNA, 16 bp, Artificial sequence
  Synthetic oligonucleotide
aatgaaagtacaatct

SEQ ID NO: 1661 - DNA, 16 bp, Artificial sequence
  Synthetic oligonucleotide
agcttgcacccagcaa

SEQ ID NO: 1662 - DNA, 16 bp, Artificial sequence
  Synthetic oligonucleotide
cacaagcttgcaccca

SEQ ID NO: 1663 - DNA, 16 bp, Artificial sequence
  Synthetic oligonucleotide
acacacacaagcttgc

SEQ ID NO: 1664 - DNA, 16 bp, Artificial sequence
  Synthetic oligonucleotide
tacacacacaagcttg

SEQ ID NO: 1665 - DNA, 16 bp, Artificial sequence
  Synthetic oligonucleotide
ccctatcccagagcct

SEQ ID NO: 1666 - DNA, 16 bp, Artificial sequence
  Synthetic oligonucleotide
ccaaatcacaaagcag

SEQ ID NO: 1667 - DNA, 16 bp, Artificial sequence
  Synthetic oligonucleotide
gcaaatcctttccatc

SEQ ID NO: 1668 - DNA, 16 bp, Artificial sequence
  Synthetic oligonucleotide
gtgatccccggaaagc

SEQ ID NO: 1669 - DNA, 16 bp, Artificial sequence
  Synthetic oligonucleotide
ttccaacacatgctct

SEQ ID NO: 1670 - DNA, 16 bp, Artificial sequence
  Synthetic oligonucleotide
caaagatgatagcttc

SEQ ID NO: 1671 - DNA, 16 bp, Artificial sequence
  Synthetic oligonucleotide
cagaaactccagatgg

SEQ ID NO: 1672 - DNA, 16 bp, Artificial sequence
  Synthetic oligonucleotide
acagaaactccagatg

SEQ ID NO: 1673 - DNA, 16 bp, Artificial sequence
  Synthetic oligonucleotide
atgaaagcccccagac

SEQ ID NO: 1674 - DNA, 16 bp, Artificial sequence
  Synthetic oligonucleotide
aaatgaaagcccccag

SEQ ID NO: 1675 - DNA, 16 bp, Artificial sequence
  Synthetic oligonucleotide
cagcagacaggcaaaa

SEQ ID NO: 1676 - DNA, 16 bp, Artificial sequence
  Synthetic oligonucleotide
aggacagcagacaggc

SEQ ID NO: 1677 - DNA, 16 bp, Artificial sequence
  Synthetic oligonucleotide
cgtgagcacttctgtc

SEQ ID NO: 1678 - DNA, 16 bp, Artificial sequence
  Synthetic oligonucleotide
gcacagccaagagatg

SEQ ID NO: 1679 - DNA, 16 bp, Artificial sequence
  Synthetic oligonucleotide
gccagcaaggatcaaa

SEQ ID NO: 1680 - DNA, 16 bp, Artificial sequence
  Synthetic oligonucleotide
gatgccagcaaggatc

SEQ ID NO: 1681 - DNA, 16 bp, Artificial sequence
  Synthetic oligonucleotide
cagatgccagcaagga

SEQ ID NO: 1682 - DNA, 16 bp, Artificial sequence
  Synthetic oligonucleotide
acagatgccagcaagg

SEQ ID NO: 1683 - DNA, 16 bp, Artificial sequence
  Synthetic oligonucleotide
gacagatgccagcaag

SEQ ID NO: 1684 - DNA, 16 bp, Artificial sequence
  Synthetic oligonucleotide
tatgacagatgccagc

SEQ ID NO: 1685 - DNA, 16 bp, Artificial sequence
  Synthetic oligonucleotide
tctgagactatgacag

SEQ ID NO: 1686 - DNA, 16 bp, Artificial sequence
  Synthetic oligonucleotide
aggtatttttgaaggc

SEQ ID NO: 1687 - DNA, 16 bp, Artificial sequence
  Synthetic oligonucleotide
ggtccaggactggtct

SEQ ID NO: 1688 - DNA, 16 bp, Artificial sequence
  Synthetic oligonucleotide
ctgcagaagaggcggg

SEQ ID NO: 1689 - DNA, 16 bp, Artificial sequence
  Synthetic oligonucleotide
aatgctgtcaccctgt

SEQ ID NO: 1690 - DNA, 16 bp, Artificial sequence
  Synthetic oligonucleotide
gattttaaatgctgtc

SEQ ID NO: 1691 - DNA, 16 bp, Artificial sequence
  Synthetic oligonucleotide
gagattttaaatgctg

SEQ ID NO: 1692 - DNA, 16 bp, Artificial sequence
  Synthetic oligonucleotide
ggcagcagaccatctt

SEQ ID NO: 1693 - DNA, 16 bp, Artificial sequence
  Synthetic oligonucleotide
caccacccaaagcctg

SEQ ID NO: 1694 - DNA, 16 bp, Artificial sequence
  Synthetic oligonucleotide
tgctacagtgtcacca

SEQ ID NO: 1695 - DNA, 16 bp, Artificial sequence
  Synthetic oligonucleotide
agctacagtcaggctt

SEQ ID NO: 1696 - DNA, 16 bp, Artificial sequence
  Synthetic oligonucleotide
tcccataggtgtacaa

SEQ ID NO: 1697 - DNA, 16 bp, Artificial sequence
  Synthetic oligonucleotide
catcaccactctacag

SEQ ID NO: 1698 - DNA, 16 bp, Artificial sequence
  Synthetic oligonucleotide
ccaatggcattgaata

SEQ ID NO: 1699 - DNA, 16 bp, Artificial sequence
  Synthetic oligonucleotide
accaatggcattgaat

SEQ ID NO: 1700 - DNA, 16 bp, Artificial sequence
  Synthetic oligonucleotide
aacttaaaatgtgcca

SEQ ID NO: 1701 - DNA, 16 bp, Artificial sequence
  Synthetic oligonucleotide
cttgtggtaaaataca

SEQ ID NO: 1702 - DNA, 16 bp, Artificial sequence
  Synthetic oligonucleotide
aaacttgtggtaaaat

SEQ ID NO: 1703 - DNA, 16 bp, Artificial sequence
  Synthetic oligonucleotide
caaacttgtggtaaaa

SEQ ID NO: 1704 - DNA, 16 bp, Artificial sequence
  Synthetic oligonucleotide
tcaaacttgtggtaaa

SEQ ID NO: 1705 - DNA, 16 bp, Artificial sequence
  Synthetic oligonucleotide
gtcaaacttgtggtaa

SEQ ID NO: 1706 - DNA, 16 bp, Artificial sequence
  Synthetic oligonucleotide
ggtcaaacttgtggta

SEQ ID NO: 1707 - DNA, 16 bp, Artificial sequence
  Synthetic oligonucleotide
gcagagtgagaacaag

SEQ ID NO: 1708 - DNA, 16 bp, Artificial sequence
  Synthetic oligonucleotide
agccaaccctggcacc

SEQ ID NO: 1709 - DNA, 16 bp, Artificial sequence
  Synthetic oligonucleotide
aacttgggcaaggaca

SEQ ID NO: 1710 - DNA, 16 bp, Artificial sequence
  Synthetic oligonucleotide
ggccactgcagcccta

SEQ ID NO: 1711 - DNA, 16 bp, Artificial sequence
  Synthetic oligonucleotide
gtatcctttcacgagg

SEQ ID NO: 1712 - DNA, 16 bp, Artificial sequence
  Synthetic oligonucleotide
tgacagtaggcaggca

SEQ ID NO: 1713 - DNA, 16 bp, Artificial sequence
  Synthetic oligonucleotide
cggagaggaagcctct

SEQ ID NO: 1714 - DNA, 16 bp, Artificial sequence
  Synthetic oligonucleotide
tatcttcccgctgaaa

SEQ ID NO: 1715 - DNA, 16 bp, Artificial sequence
  Synthetic oligonucleotide
gttaataatatcttcc

SEQ ID NO: 1716 - DNA, 16 bp, Artificial sequence
  Synthetic oligonucleotide
taaattgagaactgtg

SEQ ID NO: 1717 - DNA, 16 bp, Artificial sequence
  Synthetic oligonucleotide
agttatcaccctgttt

SEQ ID NO: 1718 - DNA, 16 bp, Artificial sequence
  Synthetic oligonucleotide
atatttcctgttaact

SEQ ID NO: 1719 - DNA, 16 bp, Artificial sequence
  Synthetic oligonucleotide
ctggagttattctcaa

SEQ ID NO: 1720 - DNA, 16 bp, Artificial sequence
  Synthetic oligonucleotide
aaagaaaatggcctac

SEQ ID NO: 1721 - DNA, 16 bp, Artificial sequence
  Synthetic oligonucleotide
ggcagttaacatttca

SEQ ID NO: 1722 - DNA, 16 bp, Artificial sequence
  Synthetic oligonucleotide
aatgggaaataaggcg

SEQ ID NO: 1723 - DNA, 16 bp, Artificial sequence
  Synthetic oligonucleotide
aaatgggaaataaggc

SEQ ID NO: 1724 - DNA, 16 bp, Artificial sequence
  Synthetic oligonucleotide
gctgaaaaagtcatga

SEQ ID NO: 1725 - DNA, 16 bp, Artificial sequence
  Synthetic oligonucleotide
tgcttggccttaccat

SEQ ID NO: 1726 - DNA, 16 bp, Artificial sequence
  Synthetic oligonucleotide
agccaagagctgcttg

SEQ ID NO: 1727 - DNA, 16 bp, Artificial sequence
  Synthetic oligonucleotide
tgtcattagaacaatg

SEQ ID NO: 1728 - DNA, 16 bp, Artificial sequence
  Synthetic oligonucleotide
gtcctaaagacggctc

SEQ ID NO: 1729 - DNA, 16 bp, Artificial sequence
  Synthetic oligonucleotide
tgtcctaaagacggct

SEQ ID NO: 1730 - DNA, 16 bp, Artificial sequence
  Synthetic oligonucleotide
acgctaaggaaaaagc

SEQ ID NO: 1731 - DNA, 16 bp, Artificial sequence
  Synthetic oligonucleotide
aagcacgctaaggaaa

SEQ ID NO: 1732 - DNA, 16 bp, Artificial sequence
  Synthetic oligonucleotide
aaacaaagcacgctaa

SEQ ID NO: 1733 - DNA, 16 bp, Artificial sequence
  Synthetic oligonucleotide
tctgtttggacaagtt

SEQ ID NO: 1734 - DNA, 16 bp, Artificial sequence
  Synthetic oligonucleotide
caccaacctctgtggg

SEQ ID NO: 1735 - DNA, 16 bp, Artificial sequence
  Synthetic oligonucleotide
ccaccaacctctgtgg

SEQ ID NO: 1736 - DNA, 16 bp, Artificial sequence
  Synthetic oligonucleotide
gtttccaaggccggcg

SEQ ID NO: 1737 - DNA, 16 bp, Artificial sequence
  Synthetic oligonucleotide
gtcaatacatatttgc

SEQ ID NO: 1738 - DNA, 16 bp, Artificial sequence
  Synthetic oligonucleotide
cataataggtgtcaat

SEQ ID NO: 1739 - DNA, 16 bp, Artificial sequence
  Synthetic oligonucleotide
gcacataataggtgtc

SEQ ID NO: 1740 - DNA, 16 bp, Artificial sequence
  Synthetic oligonucleotide
caggaactggtcctct

SEQ ID NO: 1741 - DNA, 16 bp, Artificial sequence
  Synthetic oligonucleotide
ctccaggtagaggcaa

SEQ ID NO: 1742 - DNA, 16 bp, Artificial sequence
  Synthetic oligonucleotide
acagaagctgcccctg

SEQ ID NO: 1743 - DNA, 16 bp, Artificial sequence
  Synthetic oligonucleotide
ccaaagcagaagtaga

SEQ ID NO: 1744 - DNA, 16 bp, Artificial sequence
  Synthetic oligonucleotide
cacaaccaaagcagaa

SEQ ID NO: 1745 - DNA, 16 bp, Artificial sequence
  Synthetic oligonucleotide
acacaaccaaagcaga

SEQ ID NO: 1746 - DNA, 16 bp, Artificial sequence
  Synthetic oligonucleotide
gagacctacctctgtt

SEQ ID NO: 1747 - DNA, 16 bp, Artificial sequence
  Synthetic oligonucleotide
aatcaagtcctctgga

SEQ ID NO: 1748 - DNA, 16 bp, Artificial sequence
  Synthetic oligonucleotide
ccagacaggccagggc

SEQ ID NO: 1749 - DNA, 16 bp, Artificial sequence
  Synthetic oligonucleotide
agaaggatgaatgtga

SEQ ID NO: 1750 - DNA, 16 bp, Artificial sequence
  Synthetic oligonucleotide
acagacagagaaggat

SEQ ID NO: 1751 - DNA, 16 bp, Artificial sequence
  Synthetic oligonucleotide
cgagaagagtaattca

SEQ ID NO: 1752 - DNA, 16 bp, Artificial sequence
  Synthetic oligonucleotide
gaggagcgagaagagt

SEQ ID NO: 1753 - DNA, 16 bp, Artificial sequence
  Synthetic oligonucleotide
aaattggaattgagac

SEQ ID NO: 1754 - DNA, 16 bp, Artificial sequence
  Synthetic oligonucleotide
gctgaaagaaagtccc

SEQ ID NO: 1755 - DNA, 16 bp, Artificial sequence
  Synthetic oligonucleotide
caatactgaaatgagc

SEQ ID NO: 1756 - DNA, 16 bp, Artificial sequence
  Synthetic oligonucleotide
cttattgtttttgttc

SEQ ID NO: 1757 - DNA, 16 bp, Artificial sequence
  Synthetic oligonucleotide
ccccagaaaacagccc

SEQ ID NO: 1758 - DNA, 16 bp, Artificial sequence
  Synthetic oligonucleotide
cacgatcctgggctct

SEQ ID NO: 1759 - DNA, 16 bp, Artificial sequence
  Synthetic oligonucleotide
acaggaaagtggagga

SEQ ID NO: 1760 - DNA, 16 bp, Artificial sequence
  Synthetic oligonucleotide
gaaatggctcctgcaa

SEQ ID NO: 1761 - DNA, 16 bp, Artificial sequence
  Synthetic oligonucleotide
gacttggcagccaagc

SEQ ID NO: 1762 - DNA, 16 bp, Artificial sequence
  Synthetic oligonucleotide
gatcattcccacaccc

SEQ ID NO: 1763 - DNA, 16 bp, Artificial sequence
  Synthetic oligonucleotide
aactacaaccttttta

SEQ ID NO: 1764 - DNA, 16 bp, Artificial sequence
  Synthetic oligonucleotide
tgcgagccaagagaca

SEQ ID NO: 1765 - DNA, 16 bp, Artificial sequence
  Synthetic oligonucleotide
gagtttgcgagccaag

SEQ ID NO: 1766 - DNA, 16 bp, Artificial sequence
  Synthetic oligonucleotide
gaagagtttgcgagcc

SEQ ID NO: 1767 - DNA, 16 bp, Artificial sequence
  Synthetic oligonucleotide
aaagaatggtgggtgc

SEQ ID NO: 1768 - DNA, 16 bp, Artificial sequence
  Synthetic oligonucleotide
gaaagaatggtgggtg

SEQ ID NO: 1769 - DNA, 16 bp, Artificial sequence
  Synthetic oligonucleotide
ggaggaggcaaattca

SEQ ID NO: 1770 - DNA, 16 bp, Artificial sequence
  Synthetic oligonucleotide
agaggaggaggcaaat

SEQ ID NO: 1771 - DNA, 16 bp, Artificial sequence
  Synthetic oligonucleotide
gaagtacctagaggag

SEQ ID NO: 1772 - DNA, 16 bp, Artificial sequence
  Synthetic oligonucleotide
tccactattctatgaa

SEQ ID NO: 1773 - DNA, 16 bp, Artificial sequence
  Synthetic oligonucleotide
ttccactattctatga

SEQ ID NO: 1774 - DNA, 16 bp, Artificial sequence
  Synthetic oligonucleotide
agccgatcacaaaagg

SEQ ID NO: 1775 - DNA, 16 bp, Artificial sequence
  Synthetic oligonucleotide
ataagccgatcacaaa

SEQ ID NO: 1776 - DNA, 16 bp, Artificial sequence
  Synthetic oligonucleotide
gcaataaatcaaccag

SEQ ID NO: 1777 - DNA, 16 bp, Artificial sequence
  Synthetic oligonucleotide
accgcatgcgatcggt

SEQ ID NO: 1778 - DNA, 16 bp, Artificial sequence
  Synthetic oligonucleotide
cccaccgcatgcgatc

SEQ ID NO: 1779 - DNA, 16 bp, Artificial sequence
  Synthetic oligonucleotide
ggctcccccaccgcat

SEQ ID NO: 1780 - DNA, 16 bp, Artificial sequence
  Synthetic oligonucleotide
ctcaagcccaccccgg

SEQ ID NO: 1781 - DNA, 16 bp, Artificial sequence
  Synthetic oligonucleotide
gggacagactgtcccc

SEQ ID NO: 1782 - DNA, 16 bp, Artificial sequence
  Synthetic oligonucleotide
caccgcgcagggacag

SEQ ID NO: 1783 - DNA, 16 bp, Artificial sequence
  Synthetic oligonucleotide
ctccaatctggctggt

SEQ ID NO: 1784 - DNA, 16 bp, Artificial sequence
  Synthetic oligonucleotide
cataaacatgggctcc

SEQ ID NO: 1785 - DNA, 16 bp, Artificial sequence
  Synthetic oligonucleotide
ccataaacatgggctc

SEQ ID NO: 1786 - DNA, 16 bp, Artificial sequence
  Synthetic oligonucleotide
acccagaagctgctgt

SEQ ID NO: 1787 - DNA, 16 bp, Artificial sequence
  Synthetic oligonucleotide
aataaattccaatgca

SEQ ID NO: 1788 - DNA, 16 bp, Artificial sequence
  Synthetic oligonucleotide
tttgaacatttactgc

SEQ ID NO: 1789 - DNA, 16 bp, Artificial sequence
  Synthetic oligonucleotide
tctagagggtaggaaa

SEQ ID NO: 1790 - DNA, 16 bp, Artificial sequence
  Synthetic oligonucleotide
ctccagtttctagagg

SEQ ID NO: 1791 - DNA, 16 bp, Artificial sequence
  Synthetic oligonucleotide
ccccacagatccaact

SEQ ID NO: 1792 - DNA, 16 bp, Artificial sequence
  Synthetic oligonucleotide
accaagctacttttgc

SEQ ID NO: 1793 - DNA, 16 bp, Artificial sequence
  Synthetic oligonucleotide
caggacagtttttccc

SEQ ID NO: 1794 - DNA, 16 bp, Artificial sequence
  Synthetic oligonucleotide
ggacaaaacccctaga

SEQ ID NO: 1795 - DNA, 16 bp, Artificial sequence
  Synthetic oligonucleotide
aaaaggacaaaacccc

SEQ ID NO: 1796 - DNA, 16 bp, Artificial sequence
  Synthetic oligonucleotide
cattaagccaattttc

SEQ ID NO: 1797 - DNA, 16 bp, Artificial sequence
  Synthetic oligonucleotide
agtcaagtctcttacc

SEQ ID NO: 1798 - DNA, 16 bp, Artificial sequence
  Synthetic oligonucleotide
ggaagacacaagggct

SEQ ID NO: 1799 - DNA, 16 bp, Artificial sequence
  Synthetic oligonucleotide
tgcatggcattgtctg

SEQ ID NO: 1800 - DNA, 16 bp, Artificial sequence
  Synthetic oligonucleotide
actcagagcagctctc

SEQ ID NO: 1801 - DNA, 16 bp, Artificial sequence
  Synthetic oligonucleotide
agtcgaatcatttctc

SEQ ID NO: 1802 - DNA, 16 bp, Artificial sequence
  Synthetic oligonucleotide
catgcagtcgaatcat

SEQ ID NO: 1803 - DNA, 16 bp, Artificial sequence
  Synthetic oligonucleotide
agtaaagggcctctct

SEQ ID NO: 1804 - DNA, 16 bp, Artificial sequence
  Synthetic oligonucleotide
cataatattgacagta

SEQ ID NO: 1805 - DNA, 16 bp, Artificial sequence
  Synthetic oligonucleotide
attcataatattgaca

SEQ ID NO: 1806 - DNA, 16 bp, Artificial sequence
  Synthetic oligonucleotide
ctccattcataatatt

SEQ ID NO: 1807 - DNA, 16 bp, Artificial sequence
  Synthetic oligonucleotide
gatgaatgctcctaag

SEQ ID NO: 1808 - DNA, 16 bp, Artificial sequence
  Synthetic oligonucleotide
ctaattagtgactgtg

SEQ ID NO: 1809 - DNA, 16 bp, Artificial sequence
  Synthetic oligonucleotide
acactaattagtgact

SEQ ID NO: 1810 - DNA, 16 bp, Artificial sequence
  Synthetic oligonucleotide
gcctacatatttcgca

SEQ ID NO: 1811 - DNA, 16 bp, Artificial sequence
  Synthetic oligonucleotide
caagcctacatatttc

SEQ ID NO: 1812 - DNA, 16 bp, Artificial sequence
  Synthetic oligonucleotide
ccaagcctacatattt

SEQ ID NO: 1813 - DNA, 16 bp, Artificial sequence
  Synthetic oligonucleotide
cccaagcctacatatt

SEQ ID NO: 1814 - DNA, 16 bp, Artificial sequence
  Synthetic oligonucleotide
tcccaagcctacatat

SEQ ID NO: 1815 - DNA, 16 bp, Artificial sequence
  Synthetic oligonucleotide
ctcccaagcctacata

SEQ ID NO: 1816 - DNA, 16 bp, Artificial sequence
  Synthetic oligonucleotide
tgcccaggcttggttc

SEQ ID NO: 1817 - DNA, 16 bp, Artificial sequence
  Synthetic oligonucleotide
ctttgaggagcagggt

SEQ ID NO: 1818 - DNA, 16 bp, Artificial sequence
  Synthetic oligonucleotide
tttactaccttccaga

SEQ ID NO: 1819 - DNA, 16 bp, Artificial sequence
  Synthetic oligonucleotide
aacactggttccattt

SEQ ID NO: 1820 - DNA, 16 bp, Artificial sequence
  Synthetic oligonucleotide
tgccctctcagggtct

SEQ ID NO: 1821 - DNA, 16 bp, Artificial sequence
  Synthetic oligonucleotide
ctgcagcaagaagtgg

SEQ ID NO: 1822 - DNA, 16 bp, Artificial sequence
  Synthetic oligonucleotide
agcttttagagctgcg

SEQ ID NO: 1823 - DNA, 16 bp, Artificial sequence
  Synthetic oligonucleotide
tcagaacacactttgg

SEQ ID NO: 1824 - DNA, 16 bp, Artificial sequence
  Synthetic oligonucleotide
tctaaagccaccaagc

SEQ ID NO: 1825 - DNA, 16 bp, Artificial sequence
  Synthetic oligonucleotide
atattgcctggtgtga

SEQ ID NO: 1826 - DNA, 16 bp, Artificial sequence
  Synthetic oligonucleotide
actggccgaagtgcag

SEQ ID NO: 1827 - DNA, 16 bp, Artificial sequence
  Synthetic oligonucleotide
aaacagggttccccca

SEQ ID NO: 1828 - DNA, 16 bp, Artificial sequence
  Synthetic oligonucleotide
cctaaaacagggttcc

SEQ ID NO: 1829 - DNA, 16 bp, Artificial sequence
  Synthetic oligonucleotide
ccaaccccagaggtga

SEQ ID NO: 1830 - DNA, 16 bp, Artificial sequence
  Synthetic oligonucleotide
agccatggcagaaccc

SEQ ID NO: 1831 - DNA, 16 bp, Artificial sequence
  Synthetic oligonucleotide
ccccttagcgcattct

SEQ ID NO: 1832 - DNA, 16 bp, Artificial sequence
  Synthetic oligonucleotide
ctccagtgaagtgaga

SEQ ID NO: 1833 - DNA, 16 bp, Artificial sequence
  Synthetic oligonucleotide
gtggaaggctgacctg

SEQ ID NO: 1834 - DNA, 16 bp, Artificial sequence
  Synthetic oligonucleotide
gacgatgaatcctggc

SEQ ID NO: 1835 - DNA, 16 bp, Artificial sequence
  Synthetic oligonucleotide
ctgcgagttaatcaga

SEQ ID NO: 1836 - DNA, 16 bp, Artificial sequence
  Synthetic oligonucleotide
ttagagtgagttcctc

SEQ ID NO: 1837 - DNA, 16 bp, Artificial sequence
  Synthetic oligonucleotide
ccaacggttgcctcat

SEQ ID NO: 1838 - DNA, 16 bp, Artificial sequence
  Synthetic oligonucleotide
accaacggttgcctca

SEQ ID NO: 1839 - DNA, 16 bp, Artificial sequence
  Synthetic oligonucleotide
caccacgcctcgctaa

SEQ ID NO: 1840 - DNA, 16 bp, Artificial sequence
  Synthetic oligonucleotide
catcaccacgcctcgc

SEQ ID NO: 1841 - DNA, 16 bp, Artificial sequence
  Synthetic oligonucleotide
acatcaccacgcctcg

SEQ ID NO: 1842 - DNA, 16 bp, Artificial sequence
  Synthetic oligonucleotide
aacatcaccacgcctc

SEQ ID NO: 1843 - DNA, 16 bp, Artificial sequence
  Synthetic oligonucleotide
aaacatcaccacgcct

SEQ ID NO: 1844 - DNA, 16 bp, Artificial sequence
  Synthetic oligonucleotide
caaacatcaccacgcc

SEQ ID NO: 1845 - DNA, 16 bp, Artificial sequence
  Synthetic oligonucleotide
gcgcaaacatcaccac

SEQ ID NO: 1846 - DNA, 16 bp, Artificial sequence
  Synthetic oligonucleotide
tgcacctggcaacctg

SEQ ID NO: 1847 - DNA, 16 bp, Artificial sequence
  Synthetic oligonucleotide
catttaggaacaaggg

SEQ ID NO: 1848 - DNA, 16 bp, Artificial sequence
  Synthetic oligonucleotide
caagattccatttagg

SEQ ID NO: 1849 - DNA, 16 bp, Artificial sequence
  Synthetic oligonucleotide
ccccaagattccattt

SEQ ID NO: 1850 - DNA, 16 bp, Artificial sequence
  Synthetic oligonucleotide
agaacacgggcacgcg

SEQ ID NO: 1851 - DNA, 16 bp, Artificial sequence
  Synthetic oligonucleotide
ttttaatttgaaggcg

SEQ ID NO: 1852 - DNA, 16 bp, Artificial sequence
  Synthetic oligonucleotide
ccgcacccagacccct

SEQ ID NO: 1853 - DNA, 16 bp, Artificial sequence
  Synthetic oligonucleotide
caaggaattttcccct

SEQ ID NO: 1854 - DNA, 16 bp, Artificial sequence
  Synthetic oligonucleotide
ctcaaggccacatttt

SEQ ID NO: 1855 - DNA, 16 bp, Artificial sequence
  Synthetic oligonucleotide
gaacagaccagaccct

SEQ ID NO: 1856 - DNA, 16 bp, Artificial sequence
  Synthetic oligonucleotide
tgctcatgaatgaaca

SEQ ID NO: 1857 - DNA, 16 bp, Artificial sequence
  Synthetic oligonucleotide
ggcaaaactcacagtc

SEQ ID NO: 1858 - DNA, 16 bp, Artificial sequence
  Synthetic oligonucleotide
aacctctgaaggcaaa

SEQ ID NO: 1859 - DNA, 16 bp, Artificial sequence
  Synthetic oligonucleotide
ggcctctcgctgatag

SEQ ID NO: 1860 - DNA, 16 bp, Artificial sequence
  Synthetic oligonucleotide
ggaagagccttggcct

SEQ ID NO: 1861 - DNA, 16 bp, Artificial sequence
  Synthetic oligonucleotide
aggaagagccttggcc

SEQ ID NO: 1862 - DNA, 16 bp, Artificial sequence
  Synthetic oligonucleotide
caaggactaaggaaga

SEQ ID NO: 1863 - DNA, 16 bp, Artificial sequence
  Synthetic oligonucleotide
agtacaaggactaagg

SEQ ID NO: 1864 - DNA, 16 bp, Artificial sequence
  Synthetic oligonucleotide
tcagtacaaggactaa

SEQ ID NO: 1865 - DNA, 16 bp, Artificial sequence
  Synthetic oligonucleotide
cgctttgctcccaggg

SEQ ID NO: 1866 - DNA, 16 bp, Artificial sequence
  Synthetic oligonucleotide
cacagcccacacgagt

SEQ ID NO: 1867 - DNA, 16 bp, Artificial sequence
  Synthetic oligonucleotide
ggttaatggcccagcc

SEQ ID NO: 1868 - DNA, 16 bp, Artificial sequence
  Synthetic oligonucleotide
cgccagcaatgtgctg

SEQ ID NO: 1869 - DNA, 16 bp, Artificial sequence
  Synthetic oligonucleotide
gccacctaggcaaggg

SEQ ID NO: 1870 - DNA, 16 bp, Artificial sequence
  Synthetic oligonucleotide
tgtcagccacctaggc

SEQ ID NO: 1871 - DNA, 16 bp, Artificial sequence
  Synthetic oligonucleotide
tgccaggcctgtcagc

SEQ ID NO: 1872 - DNA, 16 bp, Artificial sequence
  Synthetic oligonucleotide
cctgagatcgaggtgc

SEQ ID NO: 1873 - DNA, 16 bp, Artificial sequence
  Synthetic oligonucleotide
gaggagcaagggagtg

SEQ ID NO: 1874 - DNA, 16 bp, Artificial sequence
  Synthetic oligonucleotide
ggccaacaggaggagg

SEQ ID NO: 1875 - DNA, 16 bp, Artificial sequence
  Synthetic oligonucleotide
acccactgaaacctgg

SEQ ID NO: 1876 - DNA, 16 bp, Artificial sequence
  Synthetic oligonucleotide
tggaaaggaagactcg

SEQ ID NO: 1877 - DNA, 16 bp, Artificial sequence
  Synthetic oligonucleotide
aaaacaagacagggac

SEQ ID NO: 1878 - DNA, 16 bp, Artificial sequence
  Synthetic oligonucleotide
ccccaaaagctccaca

SEQ ID NO: 1879 - DNA, 16 bp, Artificial sequence
  Synthetic oligonucleotide
cccaaatgcctgcccc

SEQ ID NO: 1880 - DNA, 16 bp, Artificial sequence
  Synthetic oligonucleotide
ccccaagctggccttc

SEQ ID NO: 1881 - DNA, 16 bp, Artificial sequence
  Synthetic oligonucleotide
gccatacaaatgtgca

SEQ ID NO: 1882 - DNA, 16 bp, Artificial sequence
  Synthetic oligonucleotide
atggaggtgcccgtca

SEQ ID NO: 1883 - DNA, 16 bp, Artificial sequence
  Synthetic oligonucleotide
ttaagtagcagccagt

SEQ ID NO: 1884 - DNA, 16 bp, Artificial sequence
  Synthetic oligonucleotide
tgttttaagtagcagc

SEQ ID NO: 1885 - DNA, 16 bp, Artificial sequence
  Synthetic oligonucleotide
aggacctgggaaccca

SEQ ID NO: 1886 - DNA, 16 bp, Artificial sequence
  Synthetic oligonucleotide
acactaactggctcca

SEQ ID NO: 1887 - DNA, 16 bp, Artificial sequence
  Synthetic oligonucleotide
taccttaacaaagctt

SEQ ID NO: 1888 - DNA, 16 bp, Artificial sequence
  Synthetic oligonucleotide
gggctaccttaacaaa

SEQ ID NO: 1889 - DNA, 16 bp, Artificial sequence
  Synthetic oligonucleotide
cggtattaacccgggc

SEQ ID NO: 1890 - DNA, 16 bp, Artificial sequence
  Synthetic oligonucleotide
gcagaccggtattaac

SEQ ID NO: 1891 - DNA, 16 bp, Artificial sequence
  Synthetic oligonucleotide
tgcagaccggtattaa

SEQ ID NO: 1892 - DNA, 16 bp, Artificial sequence
  Synthetic oligonucleotide
gccaaatcacaacatg

SEQ ID NO: 1893 - DNA, 16 bp, Artificial sequence
  Synthetic oligonucleotide
agcagccctgtacaca

SEQ ID NO: 1894 - DNA, 16 bp, Artificial sequence
  Synthetic oligonucleotide
agcagcagccctgtac

SEQ ID NO: 1895 - DNA, 16 bp, Artificial sequence
  Synthetic oligonucleotide
taataggaaaacagtc

SEQ ID NO: 1896 - DNA, 16 bp, Artificial sequence
  Synthetic oligonucleotide
aatgagggtggcttgg

SEQ ID NO: 1897 - DNA, 16 bp, Artificial sequence
  Synthetic oligonucleotide
tgcaaagggaccctta

SEQ ID NO: 1898 - DNA, 16 bp, Artificial sequence
  Synthetic oligonucleotide
tgcagagcacagatgc

SEQ ID NO: 1899 - DNA, 16 bp, Artificial sequence
  Synthetic oligonucleotide
aacaaagcctcttctc

SEQ ID NO: 1900 - DNA, 16 bp, Artificial sequence
  Synthetic oligonucleotide
acgagacagaaagaag

SEQ ID NO: 1901 - DNA, 16 bp, Artificial sequence
  Synthetic oligonucleotide
ggacgagacagaaaga

SEQ ID NO: 1902 - DNA, 16 bp, Artificial sequence
  Synthetic oligonucleotide
aggacgagacagaaag

SEQ ID NO: 1903 - DNA, 16 bp, Artificial sequence
  Synthetic oligonucleotide
tcctagaatgaagaca

SEQ ID NO: 1904 - DNA, 16 bp, Artificial sequence
  Synthetic oligonucleotide
cagagagggttagtgg

SEQ ID NO: 1905 - DNA, 16 bp, Artificial sequence
  Synthetic oligonucleotide
aatctagaaaacacat

SEQ ID NO: 1906 - DNA, 16 bp, Artificial sequence
  Synthetic oligonucleotide
ggaatctagaaaacac

SEQ ID NO: 1907 - DNA, 16 bp, Artificial sequence
  Synthetic oligonucleotide
cagaagaagttgggaa

SEQ ID NO: 1908 - DNA, 16 bp, Artificial sequence
  Synthetic oligonucleotide
ctccagaagaagttgg

SEQ ID NO: 1909 - DNA, 16 bp, Artificial sequence
  Synthetic oligonucleotide
atccccaggctccaga

SEQ ID NO: 1910 - DNA, 16 bp, Artificial sequence
  Synthetic oligonucleotide
ccgatccccaggctcc

SEQ ID NO: 1911 - DNA, 16 bp, Artificial sequence
  Synthetic oligonucleotide
tgtgaccgatccccag

SEQ ID NO: 1912 - DNA, 16 bp, Artificial sequence
  Synthetic oligonucleotide
accagtgtgaccgatc

SEQ ID NO: 1913 - DNA, 16 bp, Artificial sequence
  Synthetic oligonucleotide
cgcaccagtgtgaccg

SEQ ID NO: 1914 - DNA, 16 bp, Artificial sequence
  Synthetic oligonucleotide
ccacgcaccagtgtga

SEQ ID NO: 1915 - DNA, 16 bp, Artificial sequence
  Synthetic oligonucleotide
gccaccacgcaccagt

SEQ ID NO: 1916 - DNA, 16 bp, Artificial sequence
  Synthetic oligonucleotide
tatgccaccacgcacc

SEQ ID NO: 1917 - DNA, 16 bp, Artificial sequence
  Synthetic oligonucleotide
atccagagagggctcc

SEQ ID NO: 1918 - DNA, 16 bp, Artificial sequence
  Synthetic oligonucleotide
gatatccagagagggc

SEQ ID NO: 1919 - DNA, 16 bp, Artificial sequence
  Synthetic oligonucleotide
gaagatatccagagag

SEQ ID NO: 1920 - DNA, 16 bp, Artificial sequence
  Synthetic oligonucleotide
atagaagatatccaga

SEQ ID NO: 1921 - DNA, 16 bp, Artificial sequence
  Synthetic oligonucleotide
atcatagaagatatcc

SEQ ID NO: 1922 - DNA, 16 bp, Artificial sequence
  Synthetic oligonucleotide
tagatcatagaagata

SEQ ID NO: 1923 - DNA, 16 bp, Artificial sequence
  Synthetic oligonucleotide
cccctgaggtagatca

SEQ ID NO: 1924 - DNA, 16 bp, Artificial sequence
  Synthetic oligonucleotide
agccattcccctgagg

SEQ ID NO: 1925 - DNA, 16 bp, Artificial sequence
  Synthetic oligonucleotide
aaaagccattcccctg

SEQ ID NO: 1926 - DNA, 16 bp, Artificial sequence
  Synthetic oligonucleotide
ggcaaaagccattccc

SEQ ID NO: 1927 - DNA, 16 bp, Artificial sequence
  Synthetic oligonucleotide
ctgcaccagctgactc

SEQ ID NO: 1928 - DNA, 16 bp, Artificial sequence
  Synthetic oligonucleotide
accttctgcaccagct

SEQ ID NO: 1929 - DNA, 16 bp, Artificial sequence
  Synthetic oligonucleotide
cgcaccttctgcacca

SEQ ID NO: 1930 - DNA, 16 bp, Artificial sequence
  Synthetic oligonucleotide
ctccgcaccttctgca

SEQ ID NO: 1931 - DNA, 16 bp, Artificial sequence
  Synthetic oligonucleotide
ttgctccgcaccttct

SEQ ID NO: 1932 - DNA, 16 bp, Artificial sequence
  Synthetic oligonucleotide
gattttgctccgcacc

SEQ ID NO: 1933 - DNA, 16 bp, Artificial sequence
  Synthetic oligonucleotide
cagccgattttgctcc

SEQ ID NO: 1934 - DNA, 16 bp, Artificial sequence
  Synthetic oligonucleotide
cagctggatgccgcag

SEQ ID NO: 1935 - DNA, 16 bp, Artificial sequence
  Synthetic oligonucleotide
cgtcagctggatgccg

SEQ ID NO: 1936 - DNA, 16 bp, Artificial sequence
  Synthetic oligonucleotide
accatccacctcccgc

SEQ ID NO: 1937 - DNA, 16 bp, Artificial sequence
  Synthetic oligonucleotide
gtgtggcggacttgat

SEQ ID NO: 1938 - DNA, 16 bp, Artificial sequence
  Synthetic oligonucleotide
tccagtgtggcggact

SEQ ID NO: 1939 - DNA, 16 bp, Artificial sequence
  Synthetic oligonucleotide
gggttgtccagtgtgg

SEQ ID NO: 1940 - DNA, 16 bp, Artificial sequence
  Synthetic oligonucleotide
gtccgggttgtccagt

SEQ ID NO: 1941 - DNA, 16 bp, Artificial sequence
  Synthetic oligonucleotide
ggagtccgggttgtcc

SEQ ID NO: 1942 - DNA, 16 bp, Artificial sequence
  Synthetic oligonucleotide
gtcctggagtccgggt

SEQ ID NO: 1943 - DNA, 16 bp, Artificial sequence
  Synthetic oligonucleotide
ttgtgtaccaacagcg

SEQ ID NO: 1944 - DNA, 16 bp, Artificial sequence
  Synthetic oligonucleotide
accttgtgtaccaaca

SEQ ID NO: 1945 - DNA, 16 bp, Artificial sequence
  Synthetic oligonucleotide
aacaccttgtgtacca

SEQ ID NO: 1946 - DNA, 16 bp, Artificial sequence
  Synthetic oligonucleotide
gggaacaccttgtgta

SEQ ID NO: 1947 - DNA, 16 bp, Artificial sequence
  Synthetic oligonucleotide
acggctgctgcataaa

SEQ ID NO: 1948 - DNA, 16 bp, Artificial sequence
  Synthetic oligonucleotide
tccacggctgctgcat

SEQ ID NO: 1949 - DNA, 16 bp, Artificial sequence
  Synthetic oligonucleotide
ccgtccacggctgctg

SEQ ID NO: 1950 - DNA, 16 bp, Artificial sequence
  Synthetic oligonucleotide
agcccgtccacggctg

SEQ ID NO: 1951 - DNA, 16 bp, Artificial sequence
  Synthetic oligonucleotide
taaagcccgtccacgg

SEQ ID NO: 1952 - DNA, 16 bp, Artificial sequence
  Synthetic oligonucleotide
cggtaaagcccgtcca

SEQ ID NO: 1953 - DNA, 16 bp, Artificial sequence
  Synthetic oligonucleotide
gcacggtaaagcccgt

SEQ ID NO: 1954 - DNA, 16 bp, Artificial sequence
  Synthetic oligonucleotide
tctgcacggtaaagcc

SEQ ID NO: 1955 - DNA, 16 bp, Artificial sequence
  Synthetic oligonucleotide
ctgatctgcacggtaa

SEQ ID NO: 1956 - DNA, 16 bp, Artificial sequence
  Synthetic oligonucleotide
aaagctgatctgcacg

SEQ ID NO: 1957 - DNA, 16 bp, Artificial sequence
  Synthetic oligonucleotide
agctgctgatgaactg

SEQ ID NO: 1958 - DNA, 16 bp, Artificial sequence
  Synthetic oligonucleotide
ggcagctgctgatgaa

SEQ ID NO: 1959 - DNA, 16 bp, Artificial sequence
  Synthetic oligonucleotide
gcacgggcagctgctg

SEQ ID NO: 1960 - DNA, 16 bp, Artificial sequence
  Synthetic oligonucleotide
ccagcacgggcagctg

SEQ ID NO: 1961 - DNA, 16 bp, Artificial sequence
  Synthetic oligonucleotide
cctctagccagcacgg

SEQ ID NO: 1962 - DNA, 16 bp, Artificial sequence
  Synthetic oligonucleotide
tgacctctagccagca

SEQ ID NO: 1963 - DNA, 16 bp, Artificial sequence
  Synthetic oligonucleotide
aagatgacctctagcc

SEQ ID NO: 1964 - DNA, 16 bp, Artificial sequence
  Synthetic oligonucleotide
ttgaagatgacctcta

SEQ ID NO: 1965 - DNA, 16 bp, Artificial sequence
  Synthetic oligonucleotide
ggctgttgaagatgac

SEQ ID NO: 1966 - DNA, 16 bp, Artificial sequence
  Synthetic oligonucleotide
taccggctgttgaaga

SEQ ID NO: 1967 - DNA, 16 bp, Artificial sequence
  Synthetic oligonucleotide
tctgtcccctccgcac

SEQ ID NO: 1968 - DNA, 16 bp, Artificial sequence
  Synthetic oligonucleotide
cgctctgtcccctccg

SEQ ID NO: 1969 - DNA, 16 bp, Artificial sequence
  Synthetic oligonucleotide
gctcacgctctgtccc

SEQ ID NO: 1970 - DNA, 16 bp, Artificial sequence
  Synthetic oligonucleotide
tcagctcacgctctgt

SEQ ID NO: 1971 - DNA, 16 bp, Artificial sequence
  Synthetic oligonucleotide
tgctcagctcacgctc

SEQ ID NO: 1972 - DNA, 16 bp, Artificial sequence
  Synthetic oligonucleotide
gcctgctcagctcacg

SEQ ID NO: 1973 - DNA, 16 bp, Artificial sequence
  Synthetic oligonucleotide
ggcctgctcagctcac

SEQ ID NO: 1974 - DNA, 16 bp, Artificial sequence
  Synthetic oligonucleotide
aagtgtggcctgctca

SEQ ID NO: 1975 - DNA, 16 bp, Artificial sequence
  Synthetic oligonucleotide
ttgaagtgtggcctgc

SEQ ID NO: 1976 - DNA, 16 bp, Artificial sequence
  Synthetic oligonucleotide
agtttgaagtgtggcc

SEQ ID NO: 1977 - DNA, 16 bp, Artificial sequence
  Synthetic oligonucleotide
aaagcaagcactcagg

SEQ ID NO: 1978 - DNA, 16 bp, Artificial sequence
  Synthetic oligonucleotide
tgaaaagcaagcactc

SEQ ID NO: 1979 - DNA, 16 bp, Artificial sequence
  Synthetic oligonucleotide
gcatgaaaagcaagca

SEQ ID NO: 1980 - DNA, 16 bp, Artificial sequence
  Synthetic oligonucleotide
gtttgcatgaaaagca

SEQ ID NO: 1981 - DNA, 16 bp, Artificial sequence
  Synthetic oligonucleotide
aaagagtttgcatgaa

SEQ ID NO: 1982 - DNA, 16 bp, Artificial sequence
  Synthetic oligonucleotide
accaaagagtttgcat

SEQ ID NO: 1983 - DNA, 16 bp, Artificial sequence
  Synthetic oligonucleotide
acgaccaaagagtttg

SEQ ID NO: 1984 - DNA, 16 bp, Artificial sequence
  Synthetic oligonucleotide
aaaacgaccaaagagt

SEQ ID NO: 1985 - DNA, 16 bp, Artificial sequence
  Synthetic oligonucleotide
aaaaaaacgaccaaag

SEQ ID NO: 1986 - DNA, 16 bp, Artificial sequence
  Synthetic oligonucleotide
cgagaagaagaaaacc

SEQ ID NO: 1987 - DNA, 16 bp, Artificial sequence
  Synthetic oligonucleotide
agctatttctcaaaga

SEQ ID NO: 1988 - DNA, 16 bp, Artificial sequence
  Synthetic oligonucleotide
ataagctatttctcaa

SEQ ID NO: 1989 - DNA, 16 bp, Artificial sequence
  Synthetic oligonucleotide
ttcataagctatttct

SEQ ID NO: 1990 - DNA, 16 bp, Artificial sequence
  Synthetic oligonucleotide
cttttcataagctatt

SEQ ID NO: 1991 - DNA, 16 bp, Artificial sequence
  Synthetic oligonucleotide
attcttttcataagct

SEQ ID NO: 1992 - DNA, 16 bp, Artificial sequence
  Synthetic oligonucleotide
aacaattcttttcata

SEQ ID NO: 1993 - DNA, 16 bp, Artificial sequence
  Synthetic oligonucleotide
cccaacaattcttttc

SEQ ID NO: 1994 - DNA, 16 bp, Artificial sequence
  Synthetic oligonucleotide
acccccaacaattctt

SEQ ID NO: 1995 - DNA, 16 bp, Artificial sequence
  Synthetic oligonucleotide
aaaacccccaacaatt

SEQ ID NO: 1996 - DNA, 16 bp, Artificial sequence
  Synthetic oligonucleotide
ttccaaaaaaaccccc

SEQ ID NO: 1997 - DNA, 16 bp, Artificial sequence
  Synthetic oligonucleotide
tcctatcagggtgtcc

SEQ ID NO: 1998 - DNA, 16 bp, Artificial sequence
  Synthetic oligonucleotide
ctcttcctatcagggt

SEQ ID NO: 1999 - DNA, 16 bp, Artificial sequence
  Synthetic oligonucleotide
tcccctcttcctatca

SEQ ID NO: 2000 - DNA, 16 bp, Artificial sequence
  Synthetic oligonucleotide
tggatttctgcttccc

SEQ ID NO: 2001 - DNA, 16 bp, Artificial sequence
  Synthetic oligonucleotide
tgcttggatttctgct

SEQ ID NO: 2002 - DNA, 16 bp, Artificial sequence
  Synthetic oligonucleotide
tttggtggtgcttgga

SEQ ID NO: 2003 - DNA, 16 bp, Artificial sequence
  Synthetic oligonucleotide
gtgtttggtggtgctt

SEQ ID NO: 2004 - DNA, 16 bp, Artificial sequence
  Synthetic oligonucleotide
acactgtgtttggtgg

SEQ ID NO: 2005 - DNA, 16 bp, Artificial sequence
  Synthetic oligonucleotide
catacactgtgtttgg

SEQ ID NO: 2006 - DNA, 16 bp, Artificial sequence
  Synthetic oligonucleotide
cttcatacactgtgtt

SEQ ID NO: 2007 - DNA, 16 bp, Artificial sequence
  Synthetic oligonucleotide
cacactcctgacaagt

SEQ ID NO: 2008 - DNA, 16 bp, Artificial sequence
  Synthetic oligonucleotide
acacacactcctgaca

SEQ ID NO: 2009 - DNA, 16 bp, Artificial sequence
  Synthetic oligonucleotide
actcacactcacacac

SEQ ID NO: 2010 - DNA, 16 bp, Artificial sequence
  Synthetic oligonucleotide
cacactcacactcaca

SEQ ID NO: 2011 - DNA, 16 bp, Artificial sequence
  Synthetic oligonucleotide
gcacactcacactcac

SEQ ID NO: 2012 - DNA, 16 bp, Artificial sequence
  Synthetic oligonucleotide
cgcacactcacactca

SEQ ID NO: 2013 - DNA, 16 bp, Artificial sequence
  Synthetic oligonucleotide
ccgcacactcacactc

SEQ ID NO: 2014 - DNA, 16 bp, Artificial sequence
  Synthetic oligonucleotide
gccgcacactcacact

SEQ ID NO: 2015 - DNA, 16 bp, Artificial sequence
  Synthetic oligonucleotide
cagccgcacactcaca

SEQ ID NO: 2016 - DNA, 16 bp, Artificial sequence
  Synthetic oligonucleotide
acagccgcacactcac

SEQ ID NO: 2017 - DNA, 16 bp, Artificial sequence
  Synthetic oligonucleotide
tccataagagacacaa

SEQ ID NO: 2018 - DNA, 16 bp, Artificial sequence
  Synthetic oligonucleotide
acatccataagagaca

SEQ ID NO: 2019 - DNA, 16 bp, Artificial sequence
  Synthetic oligonucleotide
gggacatccataagag

SEQ ID NO: 2020 - DNA, 16 bp, Artificial sequence
  Synthetic oligonucleotide
caaacctctctgctgg

SEQ ID NO: 2021 - DNA, 16 bp, Artificial sequence
  Synthetic oligonucleotide
tgcaaacctctctgct

SEQ ID NO: 2022 - DNA, 16 bp, Artificial sequence
  Synthetic oligonucleotide
ctgcaaacctctctgc

SEQ ID NO: 2023 - DNA, 16 bp, Artificial sequence
  Synthetic oligonucleotide
actgcaaacctctctg

SEQ ID NO: 2024 - DNA, 16 bp, Artificial sequence
  Synthetic oligonucleotide
gactgcaaacctctct

SEQ ID NO: 2025 - DNA, 16 bp, Artificial sequence
  Synthetic oligonucleotide
ggactgcaaacctctc

SEQ ID NO: 2026 - DNA, 16 bp, Artificial sequence
  Synthetic oligonucleotide
gggactgcaaacctct

SEQ ID NO: 2027 - DNA, 16 bp, Artificial sequence
  Synthetic oligonucleotide
cccaggtactgcctct

SEQ ID NO: 2028 - DNA, 16 bp, Artificial sequence
  Synthetic oligonucleotide
cttgcccaggtactgc

SEQ ID NO: 2029 - DNA, 16 bp, Artificial sequence
  Synthetic oligonucleotide
cgccagcttgcccagg

SEQ ID NO: 2030 - DNA, 16 bp, Artificial sequence
  Synthetic oligonucleotide
agccgccagcttgccc

SEQ ID NO: 2031 - DNA, 16 bp, Artificial sequence
  Synthetic oligonucleotide
ccccagccgccagctt

SEQ ID NO: 2032 - DNA, 16 bp, Artificial sequence
  Synthetic oligonucleotide
ggaccccagccgccag

SEQ ID NO: 2033 - DNA, 16 bp, Artificial sequence
  Synthetic oligonucleotide
tgctgggaccccagcc

SEQ ID NO: 2034 - DNA, 16 bp, Artificial sequence
  Synthetic oligonucleotide
agctgctgggacccca

SEQ ID NO: 2035 - DNA, 16 bp, Artificial sequence
  Synthetic oligonucleotide
ggcagctgctgggacc

SEQ ID NO: 2036 - DNA, 16 bp, Artificial sequence
  Synthetic oligonucleotide
tgctcctggcagctgc

SEQ ID NO: 2037 - DNA, 16 bp, Artificial sequence
  Synthetic oligonucleotide
agcctgtggacaggcc

SEQ ID NO: 2038 - DNA, 16 bp, Artificial sequence
  Synthetic oligonucleotide
cagaagcctgtggaca

SEQ ID NO: 2039 - DNA, 16 bp, Artificial sequence
  Synthetic oligonucleotide
gctcagaagcctgtgg

SEQ ID NO: 2040 - DNA, 16 bp, Artificial sequence
  Synthetic oligonucleotide
cgctgctcagaagcct

SEQ ID NO: 2041 - DNA, 16 bp, Artificial sequence
  Synthetic oligonucleotide
ggctcgctgctcagaa

SEQ ID NO: 2042 - DNA, 16 bp, Artificial sequence
  Synthetic oligonucleotide
agcaggctcgctgctc

SEQ ID NO: 2043 - DNA, 16 bp, Artificial sequence
  Synthetic oligonucleotide
actagcaggctcgctg

SEQ ID NO: 2044 - DNA, 16 bp, Artificial sequence
  Synthetic oligonucleotide
gccactagcaggctcg

SEQ ID NO: 2045 - DNA, 16 bp, Artificial sequence
  Synthetic oligonucleotide
ttcggccactagcagg

SEQ ID NO: 2046 - DNA, 16 bp, Artificial sequence
  Synthetic oligonucleotide
ctggttcggccactag

SEQ ID NO: 2047 - DNA, 16 bp, Artificial sequence
  Synthetic oligonucleotide
cgctacaatggcaggg

SEQ ID NO: 2048 - DNA, 16 bp, Artificial sequence
  Synthetic oligonucleotide
caaaaaagaaagacgc

SEQ ID NO: 2049 - DNA, 16 bp, Artificial sequence
  Synthetic oligonucleotide
agatggccaaaaaaga

SEQ ID NO: 2050 - DNA, 16 bp, Artificial sequence
  Synthetic oligonucleotide
agcagatggccaaaaa

SEQ ID NO: 2051 - DNA, 16 bp, Artificial sequence
  Synthetic oligonucleotide
caggagcagatggcca

SEQ ID NO: 2052 - DNA, 16 bp, Artificial sequence
  Synthetic oligonucleotide
atccaggagcagatgg

SEQ ID NO: 2053 - DNA, 16 bp, Artificial sequence
  Synthetic oligonucleotide
gagatccaggagcaga

SEQ ID NO: 2054 - DNA, 16 bp, Artificial sequence
  Synthetic oligonucleotide
agggagatccaggagc

SEQ ID NO: 2055 - DNA, 16 bp, Artificial sequence
  Synthetic oligonucleotide
tctcagggagatccag

SEQ ID NO: 2056 - DNA, 16 bp, Artificial sequence
  Synthetic oligonucleotide
gcccatctcagggaga

SEQ ID NO: 2057 - DNA, 16 bp, Artificial sequence
  Synthetic oligonucleotide
gtcaccagggcaggca

SEQ ID NO: 2058 - DNA, 16 bp, Artificial sequence
  Synthetic oligonucleotide
tgatgtcaccagggca

SEQ ID NO: 2059 - DNA, 16 bp, Artificial sequence
  Synthetic oligonucleotide
acctgatgtcaccagg

SEQ ID NO: 2060 - DNA, 16 bp, Artificial sequence
  Synthetic oligonucleotide
aacctgatgtcaccag

SEQ ID NO: 2061 - DNA, 16 bp, Artificial sequence
  Synthetic oligonucleotide
aaacctgatgtcacca

SEQ ID NO: 2062 - DNA, 16 bp, Artificial sequence
  Synthetic oligonucleotide
aaaacctgatgtcacc

SEQ ID NO: 2063 - DNA, 16 bp, Artificial sequence
  Synthetic oligonucleotide
aaaaacctgatgtcac

SEQ ID NO: 2064 - DNA, 16 bp, Artificial sequence
  Synthetic oligonucleotide
gaaaaacctgatgtca

SEQ ID NO: 2065 - DNA, 16 bp, Artificial sequence
  Synthetic oligonucleotide
ggaaaaacctgatgtc

SEQ ID NO: 2066 - DNA, 16 bp, Artificial sequence
  Synthetic oligonucleotide
cgggaaaaacctgatg

SEQ ID NO: 2067 - DNA, 16 bp, Artificial sequence
  Synthetic oligonucleotide
gatgggagcaggcagt

SEQ ID NO: 2068 - DNA, 16 bp, Artificial sequence
  Synthetic oligonucleotide
caggatgggagcaggc

SEQ ID NO: 2069 - DNA, 16 bp, Artificial sequence
  Synthetic oligonucleotide
acacaggatgggagca

SEQ ID NO: 2070 - DNA, 16 bp, Artificial sequence
  Synthetic oligonucleotide
taacacacaggatggg

SEQ ID NO: 2071 - DNA, 16 bp, Artificial sequence
  Synthetic oligonucleotide
gcttaacacacaggat

SEQ ID NO: 2072 - DNA, 16 bp, Artificial sequence
  Synthetic oligonucleotide
agagcttaacacacag

SEQ ID NO: 2073 - DNA, 16 bp, Artificial sequence
  Synthetic oligonucleotide
agcagagcttaacaca

SEQ ID NO: 2074 - DNA, 16 bp, Artificial sequence
  Synthetic oligonucleotide
aatagcagagcttaac

SEQ ID NO: 2075 - DNA, 16 bp, Artificial sequence
  Synthetic oligonucleotide
cctaatagcagagctt

SEQ ID NO: 2076 - DNA, 16 bp, Artificial sequence
  Synthetic oligonucleotide
ctggcctaatagcaga

SEQ ID NO: 2077 - DNA, 16 bp, Artificial sequence
  Synthetic oligonucleotide
gctaagcatgtccctc

SEQ ID NO: 2078 - DNA, 16 bp, Artificial sequence
  Synthetic oligonucleotide
actgctaagcatgtcc

SEQ ID NO: 2079 - DNA, 16 bp, Artificial sequence
  Synthetic oligonucleotide
gggactgctaagcatg

SEQ ID NO: 2080 - DNA, 16 bp, Artificial sequence
  Synthetic oligonucleotide
cttcttggagggaagg

SEQ ID NO: 2081 - DNA, 16 bp, Artificial sequence
  Synthetic oligonucleotide
aatccttcttggaggg

SEQ ID NO: 2082 - DNA, 16 bp, Artificial sequence
  Synthetic oligonucleotide
ccaaatccttcttgga

SEQ ID NO: 2083 - DNA, 16 bp, Artificial sequence
  Synthetic oligonucleotide
cggaccaaatccttct

SEQ ID NO: 2084 - DNA, 16 bp, Artificial sequence
  Synthetic oligonucleotide
tgacggaccaaatcct

SEQ ID NO: 2085 - DNA, 16 bp, Artificial sequence
  Synthetic oligonucleotide
ttatgacggaccaaat

SEQ ID NO: 2086 - DNA, 16 bp, Artificial sequence
  Synthetic oligonucleotide
gggttatgacggacca

SEQ ID NO: 2087 - DNA, 16 bp, Artificial sequence
  Synthetic oligonucleotide
gttaggtgtcagccta

SEQ ID NO: 2088 - DNA, 16 bp, Artificial sequence
  Synthetic oligonucleotide
agagttaggtgtcagc

SEQ ID NO: 2089 - DNA, 16 bp, Artificial sequence
  Synthetic oligonucleotide
agaagagttaggtgtc

SEQ ID NO: 2090 - DNA, 16 bp, Artificial sequence
  Synthetic oligonucleotide
gaaagaagagttaggt

SEQ ID NO: 2091 - DNA, 16 bp, Artificial sequence
  Synthetic oligonucleotide
gttgtagaagaaatga

SEQ ID NO: 2092 - DNA, 16 bp, Artificial sequence
  Synthetic oligonucleotide
tatgagttgtagaaga

SEQ ID NO: 2093 - DNA, 16 bp, Artificial sequence
  Synthetic oligonucleotide
gtgtatgagttgtaga

SEQ ID NO: 2094 - DNA, 16 bp, Artificial sequence
  Synthetic oligonucleotide
acgagtgtatgagttg

SEQ ID NO: 2095 - DNA, 16 bp, Artificial sequence
  Synthetic oligonucleotide
catacgagtgtatgag

SEQ ID NO: 2096 - DNA, 16 bp, Artificial sequence
  Synthetic oligonucleotide
tatcatacgagtgtat

SEQ ID NO: 2097 - DNA, 16 bp, Artificial sequence
  Synthetic oligonucleotide
ctaaacatgctcattg

SEQ ID NO: 2098 - DNA, 16 bp, Artificial sequence
  Synthetic oligonucleotide
agtctaaacatgctca

SEQ ID NO: 2099 - DNA, 16 bp, Artificial sequence
  Synthetic oligonucleotide
taaagtctaaacatgc

SEQ ID NO: 2100 - DNA, 16 bp, Artificial sequence
  Synthetic oligonucleotide
tgttaaagtctaaaca

SEQ ID NO: 2101 - DNA, 16 bp, Artificial sequence
  Synthetic oligonucleotide
ttatgttaaagtctaa

SEQ ID NO: 2102 - DNA, 16 bp, Artificial sequence
  Synthetic oligonucleotide
agcttatgttaaagtc

SEQ ID NO: 2103 - DNA, 16 bp, Artificial sequence
  Synthetic oligonucleotide
aatagcttatgttaaa

SEQ ID NO: 2104 - DNA, 16 bp, Artificial sequence
  Synthetic oligonucleotide
gaaaaatagcttatgt

SEQ ID NO: 2105 - DNA, 16 bp, Artificial sequence
  Synthetic oligonucleotide
gttagaaaaatagctt

SEQ ID NO: 2106 - DNA, 16 bp, Artificial sequence
  Synthetic oligonucleotide
gtagttagaaaaatag

SEQ ID NO: 2107 - DNA, 16 bp, Artificial sequence
  Synthetic oligonucleotide
gagaatgcttctcttg

SEQ ID NO: 2108 - DNA, 16 bp, Artificial sequence
  Synthetic oligonucleotide
atgagaatgcttctct

SEQ ID NO: 2109 - DNA, 16 bp, Artificial sequence
  Synthetic oligonucleotide
ccaatgagaatgcttc

SEQ ID NO: 2110 - DNA, 16 bp, Artificial sequence
  Synthetic oligonucleotide
tttccaatgagaatgc

SEQ ID NO: 2111 - DNA, 16 bp, Artificial sequence
  Synthetic oligonucleotide
taaatttccaatgaga

SEQ ID NO: 2112 - DNA, 16 bp, Artificial sequence
  Synthetic oligonucleotide
tgctaaatttccaatg

SEQ ID NO: 2113 - DNA, 16 bp, Artificial sequence
  Synthetic oligonucleotide
caatgctaaatttcca

SEQ ID NO: 2114 - DNA, 16 bp, Artificial sequence
  Synthetic oligonucleotide
ctacaatgctaaattt

SEQ ID NO: 2115 - DNA, 16 bp, Artificial sequence
  Synthetic oligonucleotide
gcactacaatgctaaa

SEQ ID NO: 2116 - DNA, 16 bp, Artificial sequence
  Synthetic oligonucleotide
aaagcactacaatgct

SEQ ID NO: 2117 - DNA, 16 bp, Artificial sequence
  Synthetic oligonucleotide
taataaatctcaggtt

SEQ ID NO: 2118 - DNA, 16 bp, Artificial sequence
  Synthetic oligonucleotide
ctttaataaatctcag

SEQ ID NO: 2119 - DNA, 16 bp, Artificial sequence
  Synthetic oligonucleotide
tatatttacaagtaat

SEQ ID NO: 2120 - DNA, 16 bp, Artificial sequence
  Synthetic oligonucleotide
ctttatatttacaagt

SEQ ID NO: 2121 - DNA, 16 bp, Artificial sequence
  Synthetic oligonucleotide
cgtctttatatttaca

SEQ ID NO: 2122 - DNA, 16 bp, Artificial sequence
  Synthetic oligonucleotide
tgatgcttataaaacg

SEQ ID NO: 2123 - DNA, 16 bp, Artificial sequence
  Synthetic oligonucleotide
taatgatgcttataaa

SEQ ID NO: 2124 - DNA, 16 bp, Artificial sequence
  Synthetic oligonucleotide
taaataatgatgctta

SEQ ID NO: 2125 - DNA, 16 bp, Artificial sequence
  Synthetic oligonucleotide
acataaataatgatgc

SEQ ID NO: 2126 - DNA, 16 bp, Artificial sequence
  Synthetic oligonucleotide
ttatacacattgcaca

SEQ ID NO: 2127 - DNA, 16 bp, Artificial sequence
  Synthetic oligonucleotide
tggcatttgttatttg

SEQ ID NO: 2128 - DNA, 16 bp, Artificial sequence
  Synthetic oligonucleotide
aatttggcatttgtta

SEQ ID NO: 2129 - DNA, 16 bp, Artificial sequence
  Synthetic oligonucleotide
tttaatttggcatttg

SEQ ID NO: 2130 - DNA, 16 bp, Artificial sequence
  Synthetic oligonucleotide
cttttttaatttggca

SEQ ID NO: 2131 - DNA, 16 bp, Artificial sequence
  Synthetic oligonucleotide
atcttgtgtttatctt

SEQ ID NO: 2132 - DNA, 16 bp, Artificial sequence
  Synthetic oligonucleotide
ccaatcttgtgtttat

SEQ ID NO: 2133 - DNA, 16 bp, Artificial sequence
  Synthetic oligonucleotide
acaccaatcttgtgtt

SEQ ID NO: 2134 - DNA, 16 bp, Artificial sequence
  Synthetic oligonucleotide
aaaacaccaatcttgt

SEQ ID NO: 2135 - DNA, 16 bp, Artificial sequence
  Synthetic oligonucleotide
gaaaaaaacaccaatc

SEQ ID NO: 2136 - DNA, 16 bp, Artificial sequence
  Synthetic oligonucleotide
catagaaaaaaacacc

SEQ ID NO: 2137 - DNA, 16 bp, Artificial sequence
  Synthetic oligonucleotide
taaactcctttagaaa

SEQ ID NO: 2138 - DNA, 16 bp, Artificial sequence
  Synthetic oligonucleotide
acataaactcctttag

SEQ ID NO: 2139 - DNA, 16 bp, Artificial sequence
  Synthetic oligonucleotide
ggaacataaactcctt

SEQ ID NO: 2140 - DNA, 16 bp, Artificial sequence
  Synthetic oligonucleotide
aatggaacataaactc

SEQ ID NO: 2141 - DNA, 16 bp, Artificial sequence
  Synthetic oligonucleotide
gtttaatggaacataa

SEQ ID NO: 2142 - DNA, 16 bp, Artificial sequence
  Synthetic oligonucleotide
ccgcacaccatgaaga

SEQ ID NO: 2143 - DNA, 16 bp, Artificial sequence
  Synthetic oligonucleotide
aggcgaggagaaaagt

SEQ ID NO: 2144 - DNA, 16 bp, Artificial sequence
  Synthetic oligonucleotide
ttcagatccgcctcgg

SEQ ID NO: 2145 - DNA, 16 bp, Artificial sequence
  Synthetic oligonucleotide
gcgccttcagatccgc

SEQ ID NO: 2146 - DNA, 16 bp, Artificial sequence
  Synthetic oligonucleotide
tcttgagcaccgagtg

SEQ ID NO: 2147 - DNA, 16 bp, Artificial sequence
  Synthetic oligonucleotide
gacttccgaggaatgc

SEQ ID NO: 2148 - DNA, 16 bp, Artificial sequence
  Synthetic oligonucleotide
ccgtaagattcacagc

SEQ ID NO: 2149 - DNA, 16 bp, Artificial sequence
  Synthetic oligonucleotide
ggtatctggagtaagg

SEQ ID NO: 2150 - DNA, 16 bp, Artificial sequence
  Synthetic oligonucleotide
ctgaaagccccccagg

SEQ ID NO: 2151 - DNA, 16 bp, Artificial sequence
  Synthetic oligonucleotide
gaagttgggaatctga

SEQ ID NO: 2152 - DNA, 16 bp, Artificial sequence
  Synthetic oligonucleotide
accgatccccaggctc

SEQ ID NO: 2153 - DNA, 16 bp, Artificial sequence
  Synthetic oligonucleotide
agtgtgaccgatcccc

SEQ ID NO: 2154 - DNA, 16 bp, Artificial sequence
  Synthetic oligonucleotide
caccagtgtgaccgat

SEQ ID NO: 2155 - DNA, 16 bp, Artificial sequence
  Synthetic oligonucleotide
acgcaccagtgtgacc

SEQ ID NO: 2156 - DNA, 16 bp, Artificial sequence
  Synthetic oligonucleotide
accacgcaccagtgtg

SEQ ID NO: 2157 - DNA, 16 bp, Artificial sequence
  Synthetic oligonucleotide
attcccctgaggtaga

SEQ ID NO: 2158 - DNA, 16 bp, Artificial sequence
  Synthetic oligonucleotide
tccgaggcaaaagcca

SEQ ID NO: 2159 - DNA, 16 bp, Artificial sequence
  Synthetic oligonucleotide
gactcttgttgtccga

SEQ ID NO: 2160 - DNA, 16 bp, Artificial sequence
  Synthetic oligonucleotide
agtccgggttgtccag

SEQ ID NO: 2161 - DNA, 16 bp, Artificial sequence
  Synthetic oligonucleotide
aagctgatctgcacgg

SEQ ID NO: 2162 - DNA, 16 bp, Artificial sequence
  Synthetic oligonucleotide
acctttgtagttagaa

SEQ ID NO: 2163 - DNA, 16 bp, Artificial sequence
  Synthetic oligonucleotide
aaacaccaatcttgtg

SEQ ID NO: 2164 - DNA, 16 bp, Artificial sequence
  Synthetic oligonucleotide
ataacacccatagaaa

SEQ ID NO: 2165 - DNA, 16 bp, Artificial sequence
  Synthetic oligonucleotide
aggtgataacacccat

SEQ ID NO: 2166 - DNA, 16 bp, Artificial sequence
  Synthetic oligonucleotide
agctaggtgataacac

SEQ ID NO: 2167 - DNA, 16 bp, Artificial sequence
  Synthetic oligonucleotide
gatatttagctgtcag

SEQ ID NO: 2168 - DNA, 16 bp, Artificial sequence
  Synthetic oligonucleotide
ggtgattgccttgata

SEQ ID NO: 2169 - DNA, 16 bp, Artificial sequence
  Synthetic oligonucleotide
aggcagggccgcgagg

SEQ ID NO: 2170 - DNA, 16 bp, Artificial sequence
  Synthetic oligonucleotide
aactgtttgtcttagc

SEQ ID NO: 2171 - DNA, 16 bp, Artificial sequence
  Synthetic oligonucleotide
accagttggtttgaga

SEQ ID NO: 2172 - DNA, 16 bp, Artificial sequence
  Synthetic oligonucleotide
tactcaccagttggtt

SEQ ID NO: 2173 - DNA, 16 bp, Artificial sequence
  Synthetic oligonucleotide
attttgctacctaatg

SEQ ID NO: 2174 - DNA, 16 bp, Artificial sequence
  Synthetic oligonucleotide
gattggcaggttaatc

SEQ ID NO: 2175 - DNA, 16 bp, Artificial sequence
  Synthetic oligonucleotide
ccccattcattaagcc

SEQ ID NO: 2176 - DNA, 16 bp, Artificial sequence
  Synthetic oligonucleotide
cctaaactgagcccca

SEQ ID NO: 2177 - DNA, 16 bp, Artificial sequence
  Synthetic oligonucleotide
agtgttcaacaatgct

SEQ ID NO: 2178 - DNA, 16 bp, Artificial sequence
  Synthetic oligonucleotide
cggaagtcttgtattt

SEQ ID NO: 2179 - DNA, 16 bp, Artificial sequence
  Synthetic oligonucleotide
atgaagaagtcgggcg

SEQ ID NO: 2180 - DNA, 16 bp, Artificial sequence
  Synthetic oligonucleotide
cggacgagcgcagatc

SEQ ID NO: 2181 - DNA, 16 bp, Artificial sequence
  Synthetic oligonucleotide
cgccgggcgcacggct

SEQ ID NO: 2182 - DNA, 16 bp, Artificial sequence
  Synthetic oligonucleotide
gaacactttgcacagc

SEQ ID NO: 2183 - DNA, 16 bp, Artificial sequence
  Synthetic oligonucleotide
tgcctgagatccggcc

SEQ ID NO: 2184 - DNA, 16 bp, Artificial sequence
  Synthetic oligonucleotide
ttccgaggaatgcctg

SEQ ID NO: 2185 - DNA, 16 bp, Artificial sequence
  Synthetic oligonucleotide
gtaagattcacagcaa

SEQ ID NO: 2186 - DNA, 16 bp, Artificial sequence
  Synthetic oligonucleotide
ctctagttcgcagagt

SEQ ID NO: 2187 - DNA, 16 bp, Artificial sequence
  Synthetic oligonucleotide
caccacgcaccagtgt

SEQ ID NO: 2188 - DNA, 16 bp, Artificial sequence
  Synthetic oligonucleotide
gtaactgctgcggttg

SEQ ID NO: 2189 - DNA, 16 bp, Artificial sequence
  Synthetic oligonucleotide
ctggagtccgggttgt

SEQ ID NO: 2190 - DNA, 16 bp, Artificial sequence
  Synthetic oligonucleotide
ggctgtacgccttctc

SEQ ID NO: 2191 - DNA, 16 bp, Artificial sequence
  Synthetic oligonucleotide
agctgatctgcacggt

SEQ ID NO: 2192 - DNA, 16 bp, Artificial sequence
  Synthetic oligonucleotide
agcagcaaagtagttt

SEQ ID NO: 2193 - DNA, 16 bp, Artificial sequence
  Synthetic oligonucleotide
tacgagtgtatgagtt

SEQ ID NO: 2194 - DNA, 16 bp, Artificial sequence
  Synthetic oligonucleotide
atcatacgagtgtatg

SEQ ID NO: 2195 - DNA, 16 bp, Artificial sequence
  Synthetic oligonucleotide
gtctaaacatgctcat

SEQ ID NO: 2196 - DNA, 16 bp, Artificial sequence
  Synthetic oligonucleotide
gcttatgttaaagtct

SEQ ID NO: 2197 - DNA, 16 bp, Artificial sequence
  Synthetic oligonucleotide
taaacctttgtagtta

SEQ ID NO: 2198 - DNA, 16 bp, Artificial sequence
  Synthetic oligonucleotide
ctaaatttccaatgag

SEQ ID NO: 2199 - DNA, 16 bp, Artificial sequence
  Synthetic oligonucleotide
agcactacaatgctaa

SEQ ID NO: 2200 - DNA, 16 bp, Artificial sequence
  Synthetic oligonucleotide
acctagttcgcagagt

SEQ ID NO: 2201 - DNA, 16 bp, Artificial sequence
  Synthetic oligonucleotide
cgcgaggcggtgattg

SEQ ID NO: 2202 - DNA, 16 bp, Artificial sequence
  Synthetic oligonucleotide
caccagttggtttgag

SEQ ID NO: 2203 - DNA, 16 bp, Artificial sequence
  Synthetic oligonucleotide
tgccagtctcaaatgg

SEQ ID NO: 2204 - DNA, 16 bp, Artificial sequence
  Synthetic oligonucleotide
taatttatgacaacgc

SEQ ID NO: 2205 - DNA, 16 bp, Artificial sequence
  Synthetic oligonucleotide
tgctacctaatgtcaa

SEQ ID NO: 2206 - DNA, 16 bp, Artificial sequence
  Synthetic oligonucleotide
tcctattggctgatct

SEQ ID NO: 2207 - DNA, 16 bp, Artificial sequence
  Synthetic oligonucleotide
aggttaatcacttcct

SEQ ID NO: 2208 - DNA, 16 bp, Artificial sequence
  Synthetic oligonucleotide
caaagtatacctgttc

SEQ ID NO: 2209 - DNA, 16 bp, Artificial sequence
  Synthetic oligonucleotide
caaaggtaagccagct

SEQ ID NO: 2210 - DNA, 16 bp, Artificial sequence
  Synthetic oligonucleotide
attcagggtgtcagcc

SEQ ID NO: 2211 - DNA, 16 bp, Artificial sequence
  Synthetic oligonucleotide
ggatacacttaatcaa

SEQ ID NO: 2212 - DNA, 16 bp, Artificial sequence
  Synthetic oligonucleotide
gcttatttcatgtggt

SEQ ID NO: 2213 - DNA, 16 bp, Artificial sequence
  Synthetic oligonucleotide
tcaaactttgaagcct

SEQ ID NO: 2214 - DNA, 16 bp, Artificial sequence
  Synthetic oligonucleotide
attaagcccgctctca

SEQ ID NO: 2215 - DNA, 16 bp, Artificial sequence
  Synthetic oligonucleotide
gtacaatctcctggaa

SEQ ID NO: 2216 - DNA, 16 bp, Artificial sequence
  Synthetic oligonucleotide
ctaagctacttggttt

SEQ ID NO: 2217 - DNA, 16 bp, Artificial sequence
  Synthetic oligonucleotide
tacaaggtgaaagtta

SEQ ID NO: 2218 - DNA, 16 bp, Artificial sequence
  Synthetic oligonucleotide
gggcacaccacctgcc

SEQ ID NO: 2219 - DNA, 16 bp, Artificial sequence
  Synthetic oligonucleotide
accttttccggtattt

SEQ ID NO: 2220 - DNA, 16 bp, Artificial sequence
  Synthetic oligonucleotide
tgttaggacctgggaa

SEQ ID NO: 2221 - DNA, 16 bp, Artificial sequence
  Synthetic oligonucleotide
ccggaagtcttgtatt

SEQ ID NO: 2222 - DNA, 16 bp, Artificial sequence
  Synthetic oligonucleotide
gcgctccgtggcatgc

SEQ ID NO: 2223 - DNA, 16 bp, Artificial sequence
  Synthetic oligonucleotide
gcaggcgacagcagca

SEQ ID NO: 2224 - DNA, 16 bp, Artificial sequence
  Synthetic oligonucleotide
cccgcagctcgcctcc

SEQ ID NO: 2225 - DNA, 16 bp, Artificial sequence
  Synthetic oligonucleotide
gaggcacgcggtgcgc

SEQ ID NO: 2226 - DNA, 16 bp, Artificial sequence
  Synthetic oligonucleotide
gcaccagtgtgaccga

SEQ ID NO: 2227 - DNA, 16 bp, Artificial sequence
  Synthetic oligonucleotide
cagtagagcctcccca

SEQ ID NO: 2228 - DNA, 16 bp, Artificial sequence
  Synthetic oligonucleotide
tgactcttgttgtccg

SEQ ID NO: 2229 - DNA, 16 bp, Artificial sequence
  Synthetic oligonucleotide
taactgctgcggttgt

SEQ ID NO: 2230 - DNA, 16 bp, Artificial sequence
  Synthetic oligonucleotide
cctggagtccgggttg

SEQ ID NO: 2231 - DNA, 16 bp, Artificial sequence
  Synthetic oligonucleotide
gctaaatttccaatga

SEQ ID NO: 2232 - DNA, 16 bp, Artificial sequence
  Synthetic oligonucleotide
aaacctttgtagttag

SEQ ID NO: 2233 - DNA, 16 bp, Artificial sequence
  Synthetic oligonucleotide
tcggccacacacctca

SEQ ID NO: 2234 - DNA, 16 bp, Artificial sequence
  Synthetic oligonucleotide
agcccaactgtttgtc

SEQ ID NO: 2235 - DNA, 16 bp, Artificial sequence
  Synthetic oligonucleotide
ccagttggtttgagaa

SEQ ID NO: 2236 - DNA, 16 bp, Artificial sequence
  Synthetic oligonucleotide
accatttatctggtgt

SEQ ID NO: 2237 - DNA, 16 bp, Artificial sequence
  Synthetic oligonucleotide
cccgctctcagccagg

SEQ ID NO: 2238 - DNA, 16 bp, Artificial sequence
  Synthetic oligonucleotide
cattcattaagcccgc

SEQ ID NO: 2239 - DNA, 16 bp, Artificial sequence
  Synthetic oligonucleotide
gaatcaagccctggct

SEQ ID NO: 2240 - DNA, 16 bp, Artificial sequence
  Synthetic oligonucleotide
gtcatgaaagattctt

SEQ ID NO: 2241 - DNA, 16 bp, Artificial sequence
  Synthetic oligonucleotide
gtgttcaacaatgctt

SEQ ID NO: 2242 - DNA, 16 bp, Artificial sequence
  Synthetic oligonucleotide
agtatccatcaactgc

SEQ ID NO: 2243 - DNA, 16 bp, Artificial sequence
  Synthetic oligonucleotide
ggtgactcatcaggca

SEQ ID NO: 2244 - DNA, 16 bp, Artificial sequence
  Synthetic oligonucleotide
gttaggacctgggaac

SEQ ID NO: 2245 - DNA, 16 bp, Artificial sequence
  Synthetic oligonucleotide
acgctgtggtttgtgg

SEQ ID NO: 2246 - DNA, 16 bp, Artificial sequence
  Synthetic oligonucleotide
tctcccggaggccggg

SEQ ID NO: 2247 - DNA, 16 bp, Artificial sequence
  Synthetic oligonucleotide
gtctcccggaggccgg

SEQ ID NO: 2248 - DNA, 16 bp, Artificial sequence
  Synthetic oligonucleotide
agtctcccggaggccg

SEQ ID NO: 2249 - DNA, 16 bp, Artificial sequence
  Synthetic oligonucleotide
ccagtctcccggaggc

SEQ ID NO: 2250 - DNA, 16 bp, Artificial sequence
  Synthetic oligonucleotide
gccagtctcccggagg

SEQ ID NO: 2251 - DNA, 16 bp, Artificial sequence
  Synthetic oligonucleotide
gcgccagtctcccgga

SEQ ID NO: 2252 - DNA, 16 bp, Artificial sequence
  Synthetic oligonucleotide
tgcgccagtctcccgg

SEQ ID NO: 2253 - DNA, 16 bp, Artificial sequence
  Synthetic oligonucleotide
atgcgccagtctcccg

SEQ ID NO: 2254 - DNA, 16 bp, Artificial sequence
  Synthetic oligonucleotide
gcatgcgccagtctcc

SEQ ID NO: 2255 - DNA, 16 bp, Artificial sequence
  Synthetic oligonucleotide
ggcatgcgccagtctc

SEQ ID NO: 2256 - DNA, 16 bp, Artificial sequence
  Synthetic oligonucleotide
ccgtggcatgcgccag

SEQ ID NO: 2257 - DNA, 16 bp, Artificial sequence
  Synthetic oligonucleotide
ctccgtggcatgcgcc

SEQ ID NO: 2258 - DNA, 16 bp, Artificial sequence
  Synthetic oligonucleotide
gctccgtggcatgcgc

SEQ ID NO: 2259 - DNA, 16 bp, Artificial sequence
  Synthetic oligonucleotide
ggcgcaggcgacagca

SEQ ID NO: 2260 - DNA, 16 bp, Artificial sequence
  Synthetic oligonucleotide
aggcgcaggcgacagc

SEQ ID NO: 2261 - DNA, 16 bp, Artificial sequence
  Synthetic oligonucleotide
gcaggcgcaggcgaca

SEQ ID NO: 2262 - DNA, 16 bp, Artificial sequence
  Synthetic oligonucleotide
agcaggcgcaggcgac

SEQ ID NO: 2263 - DNA, 16 bp, Artificial sequence
  Synthetic oligonucleotide
catgaagaagtcgggc

SEQ ID NO: 2264 - DNA, 16 bp, Artificial sequence
  Synthetic oligonucleotide
accatgaagaagtcgg

SEQ ID NO: 2265 - DNA, 16 bp, Artificial sequence
  Synthetic oligonucleotide
tccgcacaccatgaag

SEQ ID NO: 2266 - DNA, 16 bp, Artificial sequence
  Synthetic oligonucleotide
cctccgcacaccatga

SEQ ID NO: 2267 - DNA, 16 bp, Artificial sequence
  Synthetic oligonucleotide
ggagcgaacatgacct

SEQ ID NO: 2268 - DNA, 16 bp, Artificial sequence
  Synthetic oligonucleotide
aggagcgaacatgacc

SEQ ID NO: 2269 - DNA, 16 bp, Artificial sequence
  Synthetic oligonucleotide
taaggagcgaacatga

SEQ ID NO: 2270 - DNA, 16 bp, Artificial sequence
  Synthetic oligonucleotide
tgctaaggagcgaaca

SEQ ID NO: 2271 - DNA, 16 bp, Artificial sequence
  Synthetic oligonucleotide
ctgctaaggagcgaac

SEQ ID NO: 2272 - DNA, 16 bp, Artificial sequence
  Synthetic oligonucleotide
ccggacgagcgcagat

SEQ ID NO: 2273 - DNA, 16 bp, Artificial sequence
  Synthetic oligonucleotide
cgccggacgagcgcag

SEQ ID NO: 2274 - DNA, 16 bp, Artificial sequence
  Synthetic oligonucleotide
acgccggacgagcgca

SEQ ID NO: 2275 - DNA, 16 bp, Artificial sequence
  Synthetic oligonucleotide
acggctcctccagaga

SEQ ID NO: 2276 - DNA, 16 bp, Artificial sequence
  Synthetic oligonucleotide
cgggcgcacggctcct

SEQ ID NO: 2277 - DNA, 16 bp, Artificial sequence
  Synthetic oligonucleotide
ccgggcgcacggctcc

SEQ ID NO: 2278 - DNA, 16 bp, Artificial sequence
  Synthetic oligonucleotide
tcgccgccgggcgcac

SEQ ID NO: 2279 - DNA, 16 bp, Artificial sequence
  Synthetic oligonucleotide
ctcgccgccgggcgca

SEQ ID NO: 2280 - DNA, 16 bp, Artificial sequence
  Synthetic oligonucleotide
tcctcgccgccgggcg

SEQ ID NO: 2281 - DNA, 16 bp, Artificial sequence
  Synthetic oligonucleotide
cgtcctcgccgccggg

SEQ ID NO: 2282 - DNA, 16 bp, Artificial sequence
  Synthetic oligonucleotide
gcagctcgcctcctcc

SEQ ID NO: 2283 - DNA, 16 bp, Artificial sequence
  Synthetic oligonucleotide
ccgcagctcgcctcct

SEQ ID NO: 2284 - DNA, 16 bp, Artificial sequence
  Synthetic oligonucleotide
tccccgcagctcgcct

SEQ ID NO: 2285 - DNA, 16 bp, Artificial sequence
  Synthetic oligonucleotide
tctccccgcagctcgc

SEQ ID NO: 2286 - DNA, 16 bp, Artificial sequence
  Synthetic oligonucleotide
ttctccccgcagctcg

SEQ ID NO: 2287 - DNA, 16 bp, Artificial sequence
  Synthetic oligonucleotide
ccgtcgccccttctcc

SEQ ID NO: 2288 - DNA, 16 bp, Artificial sequence
  Synthetic oligonucleotide
ccggccccatgcgctc

SEQ ID NO: 2289 - DNA, 16 bp, Artificial sequence
  Synthetic oligonucleotide
caccggccccatgcgc

SEQ ID NO: 2290 - DNA, 16 bp, Artificial sequence
  Synthetic oligonucleotide
ccgccaccggccccat

SEQ ID NO: 2291 - DNA, 16 bp, Artificial sequence
  Synthetic oligonucleotide
ccgccttgcccaggca

SEQ ID NO: 2292 - DNA, 16 bp, Artificial sequence
  Synthetic oligonucleotide
tcagatccgcctcggc

SEQ ID NO: 2293 - DNA, 16 bp, Artificial sequence
  Synthetic oligonucleotide
ccttcagatccgcctc

SEQ ID NO: 2294 - DNA, 16 bp, Artificial sequence
  Synthetic oligonucleotide
gtttcttgagcaccga

SEQ ID NO: 2295 - DNA, 16 bp, Artificial sequence
  Synthetic oligonucleotide
ccgctccttcagtttc

SEQ ID NO: 2296 - DNA, 16 bp, Artificial sequence
  Synthetic oligonucleotide
gccgctccttcagttt

SEQ ID NO: 2297 - DNA, 16 bp, Artificial sequence
  Synthetic oligonucleotide
ctgccgctccttcagt

SEQ ID NO: 2298 - DNA, 16 bp, Artificial sequence
  Synthetic oligonucleotide
ggaggcacgcggtgcg

SEQ ID NO: 2299 - DNA, 16 bp, Artificial sequence
  Synthetic oligonucleotide
gcaggaggcacgcggt

SEQ ID NO: 2300 - DNA, 16 bp, Artificial sequence
  Synthetic oligonucleotide
cagcaggaggcacgcg

SEQ ID NO: 2301 - DNA, 16 bp, Artificial sequence
  Synthetic oligonucleotide
cagtccaggcggccgg

SEQ ID NO: 2302 - DNA, 16 bp, Artificial sequence
  Synthetic oligonucleotide
gcagtccaggcggccg

SEQ ID NO: 2303 - DNA, 16 bp, Artificial sequence
  Synthetic oligonucleotide
aggacgagggcggctg

SEQ ID NO: 2304 - DNA, 16 bp, Artificial sequence
  Synthetic oligonucleotide
gtaggacgagggcggc

SEQ ID NO: 2305 - DNA, 16 bp, Artificial sequence
  Synthetic oligonucleotide
agtaggacgagggcgg

SEQ ID NO: 2306 - DNA, 16 bp, Artificial sequence
  Synthetic oligonucleotide
cgagtaggacgagggc

SEQ ID NO: 2307 - DNA, 16 bp, Artificial sequence
  Synthetic oligonucleotide
gcgagtaggacgaggg

SEQ ID NO: 2308 - DNA, 16 bp, Artificial sequence
  Synthetic oligonucleotide
gagcgagtaggacgag

SEQ ID NO: 2309 - DNA, 16 bp, Artificial sequence
  Synthetic oligonucleotide
ggagcgagtaggacga

SEQ ID NO: 2310 - DNA, 16 bp, Artificial sequence
  Synthetic oligonucleotide
gggagcgagtaggacg

SEQ ID NO: 2311 - DNA, 16 bp, Artificial sequence
  Synthetic oligonucleotide
cggccacctgaacact

SEQ ID NO: 2312 - DNA, 16 bp, Artificial sequence
  Synthetic oligonucleotide
ccggccacctgaacac

SEQ ID NO: 2313 - DNA, 16 bp, Artificial sequence
  Synthetic oligonucleotide
atccggccacctgaac

SEQ ID NO: 2314 - DNA, 16 bp, Artificial sequence
  Synthetic oligonucleotide
gatccggccacctgaa

SEQ ID NO: 2315 - DNA, 16 bp, Artificial sequence
  Synthetic oligonucleotide
agatccggccacctga

SEQ ID NO: 2316 - DNA, 16 bp, Artificial sequence
  Synthetic oligonucleotide
atgcctgagatccggc

SEQ ID NO: 2317 - DNA, 16 bp, Artificial sequence
  Synthetic oligonucleotide
gaatgcctgagatccg

SEQ ID NO: 2318 - DNA, 16 bp, Artificial sequence
  Synthetic oligonucleotide
ggaatgcctgagatcc

SEQ ID NO: 2319 - DNA, 16 bp, Artificial sequence
  Synthetic oligonucleotide
tccgaggaatgcctga

SEQ ID NO: 2320 - DNA, 16 bp, Artificial sequence
  Synthetic oligonucleotide
acttccgaggaatgcc

SEQ ID NO: 2321 - DNA, 16 bp, Artificial sequence
  Synthetic oligonucleotide
cccgtaagattcacag

SEQ ID NO: 2322 - DNA, 16 bp, Artificial sequence
  Synthetic oligonucleotide
ttcccgtaagattcac

SEQ ID NO: 2323 - DNA, 16 bp, Artificial sequence
  Synthetic oligonucleotide
cttcccgtaagattca

SEQ ID NO: 2324 - DNA, 16 bp, Artificial sequence
  Synthetic oligonucleotide
tcttcccgtaagattc

SEQ ID NO: 2325 - DNA, 16 bp, Artificial sequence
  Synthetic oligonucleotide
gatcttcccgtaagat

SEQ ID NO: 2326 - DNA, 16 bp, Artificial sequence
  Synthetic oligonucleotide
tgatcttcccgtaaga

SEQ ID NO: 2327 - DNA, 16 bp, Artificial sequence
  Synthetic oligonucleotide
ttgatcttcccgtaag

SEQ ID NO: 2328 - DNA, 16 bp, Artificial sequence
  Synthetic oligonucleotide
ggttgatcttcccgta

SEQ ID NO: 2329 - DNA, 16 bp, Artificial sequence
  Synthetic oligonucleotide
gggttgatcttcccgt

SEQ ID NO: 2330 - DNA, 16 bp, Artificial sequence
  Synthetic oligonucleotide
tcggctaaggtgatgg

SEQ ID NO: 2331 - DNA, 16 bp, Artificial sequence
  Synthetic oligonucleotide
gtcggctaaggtgatg

SEQ ID NO: 2332 - DNA, 16 bp, Artificial sequence
  Synthetic oligonucleotide
agtcggctaaggtgat

SEQ ID NO: 2333 - DNA, 16 bp, Artificial sequence
  Synthetic oligonucleotide
ttcgcagagtcggcta

SEQ ID NO: 2334 - DNA, 16 bp, Artificial sequence
  Synthetic oligonucleotide
agttcgcagagtcggc

SEQ ID NO: 2335 - DNA, 16 bp, Artificial sequence
  Synthetic oligonucleotide
tagttcgcagagtcgg

SEQ ID NO: 2336 - DNA, 16 bp, Artificial sequence
  Synthetic oligonucleotide
tctagttcgcagagtc

SEQ ID NO: 2337 - DNA, 16 bp, Artificial sequence
  Synthetic oligonucleotide
gactctagttcgcaga

SEQ ID NO: 2338 - DNA, 16 bp, Artificial sequence
  Synthetic oligonucleotide
agactctagttcgcag

SEQ ID NO: 2339 - DNA, 16 bp, Artificial sequence
  Synthetic oligonucleotide
ggagactctagttcgc

SEQ ID NO: 2340 - DNA, 16 bp, Artificial sequence
  Synthetic oligonucleotide
gggagactctagttcg

SEQ ID NO: 2341 - DNA, 16 bp, Artificial sequence
  Synthetic oligonucleotide
atcgggtatctggagt

SEQ ID NO: 2342 - DNA, 16 bp, Artificial sequence
  Synthetic oligonucleotide
tccatcgggtatctgg

SEQ ID NO: 2343 - DNA, 16 bp, Artificial sequence
  Synthetic oligonucleotide
gtctgcagttggtttg

SEQ ID NO: 2344 - DNA, 16 bp, Artificial sequence
  Synthetic oligonucleotide
tgtttcagcggaggaa

SEQ ID NO: 2345 - DNA, 16 bp, Artificial sequence
  Synthetic oligonucleotide
tctgaaagccccccag

SEQ ID NO: 2346 - DNA, 16 bp, Artificial sequence
  Synthetic oligonucleotide
aatctgaaagcccccc

SEQ ID NO: 2347 - DNA, 16 bp, Artificial sequence
  Synthetic oligonucleotide
gaccgatccccaggct

SEQ ID NO: 2348 - DNA, 16 bp, Artificial sequence
  Synthetic oligonucleotide
tgaccgatccccaggc

SEQ ID NO: 2349 - DNA, 16 bp, Artificial sequence
  Synthetic oligonucleotide
gtgaccgatccccagg

SEQ ID NO: 2350 - DNA, 16 bp, Artificial sequence
  Synthetic oligonucleotide
gtgtgaccgatcccca

SEQ ID NO: 2351 - DNA, 16 bp, Artificial sequence
  Synthetic oligonucleotide
cagtgtgaccgatccc

SEQ ID NO: 2352 - DNA, 16 bp, Artificial sequence
  Synthetic oligonucleotide
ccagtgtgaccgatcc

SEQ ID NO: 2353 - DNA, 16 bp, Artificial sequence
  Synthetic oligonucleotide
ccagtatgccaccacg

SEQ ID NO: 2354 - DNA, 16 bp, Artificial sequence
  Synthetic oligonucleotide
cccagtatgccaccac

SEQ ID NO: 2355 - DNA, 16 bp, Artificial sequence
  Synthetic oligonucleotide
acacagtagagcctcc

SEQ ID NO: 2356 - DNA, 16 bp, Artificial sequence
  Synthetic oligonucleotide
ggacacagtagagcct

SEQ ID NO: 2357 - DNA, 16 bp, Artificial sequence
  Synthetic oligonucleotide
tggacacagtagagcc

SEQ ID NO: 2358 - DNA, 16 bp, Artificial sequence
  Synthetic oligonucleotide
ccgaggcaaaagccat

SEQ ID NO: 2359 - DNA, 16 bp, Artificial sequence
  Synthetic oligonucleotide
gaattgagctgtccga

SEQ ID NO: 2360 - DNA, 16 bp, Artificial sequence
  Synthetic oligonucleotide
cgaattgagctgtccg

SEQ ID NO: 2361 - DNA, 16 bp, Artificial sequence
  Synthetic oligonucleotide
tccgaattgagctgtc

SEQ ID NO: 2362 - DNA, 16 bp, Artificial sequence
  Synthetic oligonucleotide
gtccgaattgagctgt

SEQ ID NO: 2363 - DNA, 16 bp, Artificial sequence
  Synthetic oligonucleotide
tgtccgaattgagctg

SEQ ID NO: 2364 - DNA, 16 bp, Artificial sequence
  Synthetic oligonucleotide
ttgtccgaattgagct

SEQ ID NO: 2365 - DNA, 16 bp, Artificial sequence
  Synthetic oligonucleotide
tgttgtccgaattgag

SEQ ID NO: 2366 - DNA, 16 bp, Artificial sequence
  Synthetic oligonucleotide
ttgttgtccgaattga

SEQ ID NO: 2367 - DNA, 16 bp, Artificial sequence
  Synthetic oligonucleotide
cttgttgtccgaattg

SEQ ID NO: 2368 - DNA, 16 bp, Artificial sequence
  Synthetic oligonucleotide
tcttgttgtccgaatt

SEQ ID NO: 2369 - DNA, 16 bp, Artificial sequence
  Synthetic oligonucleotide
actcttgttgtccgaa

SEQ ID NO: 2370 - DNA, 16 bp, Artificial sequence
  Synthetic oligonucleotide
gctgactcttgttgtc

SEQ ID NO: 2371 - DNA, 16 bp, Artificial sequence
  Synthetic oligonucleotide
agctgactcttgttgt

SEQ ID NO: 2372 - DNA, 16 bp, Artificial sequence
  Synthetic oligonucleotide
accagctgactcttgt

SEQ ID NO: 2373 - DNA, 16 bp, Artificial sequence
  Synthetic oligonucleotide
tgcaccagctgactct

SEQ ID NO: 2374 - DNA, 16 bp, Artificial sequence
  Synthetic oligonucleotide
tgctccgcaccttctg

SEQ ID NO: 2375 - DNA, 16 bp, Artificial sequence
  Synthetic oligonucleotide
ttttgctccgcacctt

SEQ ID NO: 2376 - DNA, 16 bp, Artificial sequence
  Synthetic oligonucleotide
gtcagctggatgccgc

SEQ ID NO: 2377 - DNA, 16 bp, Artificial sequence
  Synthetic oligonucleotide
ccatccacctcccgcg

SEQ ID NO: 2378 - DNA, 16 bp, Artificial sequence
  Synthetic oligonucleotide
ctgctgcggttgtaca

SEQ ID NO: 2379 - DNA, 16 bp, Artificial sequence
  Synthetic oligonucleotide
actgctgcggttgtac

SEQ ID NO: 2380 - DNA, 16 bp, Artificial sequence
  Synthetic oligonucleotide
gggtaactgctgcggt

SEQ ID NO: 2381 - DNA, 16 bp, Artificial sequence
  Synthetic oligonucleotide
ggcggacttgatgaag

SEQ ID NO: 2382 - DNA, 16 bp, Artificial sequence
  Synthetic oligonucleotide
gtggcggacttgatga

SEQ ID NO: 2383 - DNA, 16 bp, Artificial sequence
  Synthetic oligonucleotide
tgtggcggacttgatg

SEQ ID NO: 2384 - DNA, 16 bp, Artificial sequence
  Synthetic oligonucleotide
agtgtggcggacttga

SEQ ID NO: 2385 - DNA, 16 bp, Artificial sequence
  Synthetic oligonucleotide
cagtgtggcggacttg

SEQ ID NO: 2386 - DNA, 16 bp, Artificial sequence
  Synthetic oligonucleotide
ccagtgtggcggactt

SEQ ID NO: 2387 - DNA, 16 bp, Artificial sequence
  Synthetic oligonucleotide
gtccagtgtggcggac

SEQ ID NO: 2388 - DNA, 16 bp, Artificial sequence
  Synthetic oligonucleotide
tgtccagtgtggcgga

SEQ ID NO: 2389 - DNA, 16 bp, Artificial sequence
  Synthetic oligonucleotide
ttgtccagtgtggcgg

SEQ ID NO: 2390 - DNA, 16 bp, Artificial sequence
  Synthetic oligonucleotide
gttgtccagtgtggcg

SEQ ID NO: 2391 - DNA, 16 bp, Artificial sequence
  Synthetic oligonucleotide
cgggttgtccagtgtg

SEQ ID NO: 2392 - DNA, 16 bp, Artificial sequence
  Synthetic oligonucleotide
ccgggttgtccagtgt

SEQ ID NO: 2393 - DNA, 16 bp, Artificial sequence
  Synthetic oligonucleotide
tccgggttgtccagtg

SEQ ID NO: 2394 - DNA, 16 bp, Artificial sequence
  Synthetic oligonucleotide
gagtccgggttgtcca

SEQ ID NO: 2395 - DNA, 16 bp, Artificial sequence
  Synthetic oligonucleotide
tggagtccgggttgtc

SEQ ID NO: 2396 - DNA, 16 bp, Artificial sequence
  Synthetic oligonucleotide
tcctggagtccgggtt

SEQ ID NO: 2397 - DNA, 16 bp, Artificial sequence
  Synthetic oligonucleotide
cgtcctggagtccggg

SEQ ID NO: 2398 - DNA, 16 bp, Artificial sequence
  Synthetic oligonucleotide
aggctgtacgccttct

SEQ ID NO: 2399 - DNA, 16 bp, Artificial sequence
  Synthetic oligonucleotide
caggctgtacgccttc

SEQ ID NO: 2400 - DNA, 16 bp, Artificial sequence
  Synthetic oligonucleotide
tgcaggctgtacgcct

SEQ ID NO: 2401 - DNA, 16 bp, Artificial sequence
  Synthetic oligonucleotide
ccgctgcaggctgtac

SEQ ID NO: 2402 - DNA, 16 bp, Artificial sequence
  Synthetic oligonucleotide
gtggtcattgggccgc

SEQ ID NO: 2403 - DNA, 16 bp, Artificial sequence
  Synthetic oligonucleotide
cgtggtcattgggccg

SEQ ID NO: 2404 - DNA, 16 bp, Artificial sequence
  Synthetic oligonucleotide
gtccacggctgctgca

SEQ ID NO: 2405 - DNA, 16 bp, Artificial sequence
  Synthetic oligonucleotide
cgtccacggctgctgc

SEQ ID NO: 2406 - DNA, 16 bp, Artificial sequence
  Synthetic oligonucleotide
aagcccgtccacggct

SEQ ID NO: 2407 - DNA, 16 bp, Artificial sequence
  Synthetic oligonucleotide
atctgcacggtaaagc

SEQ ID NO: 2408 - DNA, 16 bp, Artificial sequence
  Synthetic oligonucleotide
gatctgcacggtaaag

SEQ ID NO: 2409 - DNA, 16 bp, Artificial sequence
  Synthetic oligonucleotide
tgatctgcacggtaaa

SEQ ID NO: 2410 - DNA, 16 bp, Artificial sequence
  Synthetic oligonucleotide
gctgatctgcacggta

SEQ ID NO: 2411 - DNA, 16 bp, Artificial sequence
  Synthetic oligonucleotide
tcacaaagctgatctg

SEQ ID NO: 2412 - DNA, 16 bp, Artificial sequence
  Synthetic oligonucleotide
cgggtgtagcactggc

SEQ ID NO: 2413 - DNA, 16 bp, Artificial sequence
  Synthetic oligonucleotide
gcgggtgtagcactgg

SEQ ID NO: 2414 - DNA, 16 bp, Artificial sequence
  Synthetic oligonucleotide
tggcgggtgtagcact

SEQ ID NO: 2415 - DNA, 16 bp, Artificial sequence
  Synthetic oligonucleotide
acgggcagctgctgat

SEQ ID NO: 2416 - DNA, 16 bp, Artificial sequence
  Synthetic oligonucleotide
cacgggcagctgctga

SEQ ID NO: 2417 - DNA, 16 bp, Artificial sequence
  Synthetic oligonucleotide
agcacgggcagctgct

SEQ ID NO: 2418 - DNA, 16 bp, Artificial sequence
  Synthetic oligonucleotide
cagcacgggcagctgc

SEQ ID NO: 2419 - DNA, 16 bp, Artificial sequence
  Synthetic oligonucleotide
ctgttgaagatgacct

SEQ ID NO: 2420 - DNA, 16 bp, Artificial sequence
  Synthetic oligonucleotide
gctgttgaagatgacc

SEQ ID NO: 2421 - DNA, 16 bp, Artificial sequence
  Synthetic oligonucleotide
cggctgttgaagatga

SEQ ID NO: 2422 - DNA, 16 bp, Artificial sequence
  Synthetic oligonucleotide
ccggctgttgaagatg

SEQ ID NO: 2423 - DNA, 16 bp, Artificial sequence
  Synthetic oligonucleotide
accggctgttgaagat

SEQ ID NO: 2424 - DNA, 16 bp, Artificial sequence
  Synthetic oligonucleotide
ctaccggctgttgaag

SEQ ID NO: 2425 - DNA, 16 bp, Artificial sequence
  Synthetic oligonucleotide
cggctaccggctgttg

SEQ ID NO: 2426 - DNA, 16 bp, Artificial sequence
  Synthetic oligonucleotide
gagtttgcatgaaaag

SEQ ID NO: 2427 - DNA, 16 bp, Artificial sequence
  Synthetic oligonucleotide
cgaccaaagagtttgc

SEQ ID NO: 2428 - DNA, 16 bp, Artificial sequence
  Synthetic oligonucleotide
aacgaccaaagagttt

SEQ ID NO: 2429 - DNA, 16 bp, Artificial sequence
  Synthetic oligonucleotide
ccttgggttatgacgg

SEQ ID NO: 2430 - DNA, 16 bp, Artificial sequence
  Synthetic oligonucleotide
accttgggttatgacg

SEQ ID NO: 2431 - DNA, 16 bp, Artificial sequence
  Synthetic oligonucleotide
ggtaccttgggttatg

SEQ ID NO: 2432 - DNA, 16 bp, Artificial sequence
  Synthetic oligonucleotide
gaagagttaggtgtca

SEQ ID NO: 2433 - DNA, 16 bp, Artificial sequence
  Synthetic oligonucleotide
agtgtatgagttgtag

SEQ ID NO: 2434 - DNA, 16 bp, Artificial sequence
  Synthetic oligonucleotide
gagtgtatgagttgta

SEQ ID NO: 2435 - DNA, 16 bp, Artificial sequence
  Synthetic oligonucleotide
cgagtgtatgagttgt

SEQ ID NO: 2436 - DNA, 16 bp, Artificial sequence
  Synthetic oligonucleotide
atacgagtgtatgagt

SEQ ID NO: 2437 - DNA, 16 bp, Artificial sequence
  Synthetic oligonucleotide
tcatacgagtgtatga

SEQ ID NO: 2438 - DNA, 16 bp, Artificial sequence
  Synthetic oligonucleotide
gtatcatacgagtgta

SEQ ID NO: 2439 - DNA, 16 bp, Artificial sequence
  Synthetic oligonucleotide
agtatcatacgagtgt

SEQ ID NO: 2440 - DNA, 16 bp, Artificial sequence
  Synthetic oligonucleotide
ctcattgagctaagaa

SEQ ID NO: 2441 - DNA, 16 bp, Artificial sequence
  Synthetic oligonucleotide
atgctcattgagctaa

SEQ ID NO: 2442 - DNA, 16 bp, Artificial sequence
  Synthetic oligonucleotide
catgctcattgagcta

SEQ ID NO: 2443 - DNA, 16 bp, Artificial sequence
  Synthetic oligonucleotide
aagtctaaacatgctc

SEQ ID NO: 2444 - DNA, 16 bp, Artificial sequence
  Synthetic oligonucleotide
cactacaatgctaaat

SEQ ID NO: 2445 - DNA, 16 bp, Artificial sequence
  Synthetic oligonucleotide
accaatcttgtgttta

SEQ ID NO: 2446 - DNA, 16 bp, Artificial sequence
  Synthetic oligonucleotide
caccaatcttgtgttt

SEQ ID NO: 2447 - DNA, 16 bp, Artificial sequence
  Synthetic oligonucleotide
aacaccaatcttgtgt

SEQ ID NO: 2448 - DNA, 16 bp, Artificial sequence
  Synthetic oligonucleotide
tgataacacccataga

SEQ ID NO: 2449 - DNA, 16 bp, Artificial sequence
  Synthetic oligonucleotide
gtgataacacccatag

SEQ ID NO: 2450 - DNA, 16 bp, Artificial sequence
  Synthetic oligonucleotide
taggtgataacaccca

SEQ ID NO: 2451 - DNA, 16 bp, Artificial sequence
  Synthetic oligonucleotide
ctaggtgataacaccc

SEQ ID NO: 2452 - DNA, 16 bp, Artificial sequence
  Synthetic oligonucleotide
cagctaggtgataaca

SEQ ID NO: 2453 - DNA, 16 bp, Artificial sequence
  Synthetic oligonucleotide
ttcagctaggtgataa

SEQ ID NO: 2454 - DNA, 16 bp, Artificial sequence
  Synthetic oligonucleotide
attcagctaggtgata

SEQ ID NO: 2455 - DNA, 16 bp, Artificial sequence
  Synthetic oligonucleotide
acattcagctaggtga

SEQ ID NO: 2456 - DNA, 16 bp, Artificial sequence
  Synthetic oligonucleotide
ccagttaatcattact

SEQ ID NO: 2457 - DNA, 16 bp, Artificial sequence
  Synthetic oligonucleotide
gccagttaatcattac

SEQ ID NO: 2458 - DNA, 16 bp, Artificial sequence
  Synthetic oligonucleotide
gcagccagttaatcat

SEQ ID NO: 2459 - DNA, 16 bp, Artificial sequence
  Synthetic oligonucleotide
gggcagccagttaatc

SEQ ID NO: 2460 - DNA, 16 bp, Artificial sequence
  Synthetic oligonucleotide
cgggcagccagttaat

SEQ ID NO: 2461 - DNA, 16 bp, Artificial sequence
  Synthetic oligonucleotide
ccgggcagccagttaa

SEQ ID NO: 2462 - DNA, 16 bp, Artificial sequence
  Synthetic oligonucleotide
tccgggcagccagtta

SEQ ID NO: 2463 - DNA, 16 bp, Artificial sequence
  Synthetic oligonucleotide
gctccgggcagccagt

SEQ ID NO: 2464 - DNA, 16 bp, Artificial sequence
  Synthetic oligonucleotide
acccgtctgggctccg

SEQ ID NO: 2465 - DNA, 16 bp, Artificial sequence
  Synthetic oligonucleotide
gtcacccgtctgggct

SEQ ID NO: 2466 - DNA, 16 bp, Artificial sequence
  Synthetic oligonucleotide
ttgtcacccgtctggg

SEQ ID NO: 2467 - DNA, 16 bp, Artificial sequence
  Synthetic oligonucleotide
cttgtcacccgtctgg

SEQ ID NO: 2468 - DNA, 16 bp, Artificial sequence
  Synthetic oligonucleotide
ccttgtcacccgtctg

SEQ ID NO: 2469 - DNA, 16 bp, Artificial sequence
  Synthetic oligonucleotide
caccttgtcacccgtc

SEQ ID NO: 2470 - DNA, 16 bp, Artificial sequence
  Synthetic oligonucleotide
gcaccttgtcacccgt

SEQ ID NO: 2471 - DNA, 16 bp, Artificial sequence
  Synthetic oligonucleotide
ttattaatggtctgct

SEQ ID NO: 2472 - DNA, 16 bp, Artificial sequence
  Synthetic oligonucleotide
attattaatggtctgc

SEQ ID NO: 2473 - DNA, 16 bp, Artificial sequence
  Synthetic oligonucleotide
tgattattaatggtct

SEQ ID NO: 2474 - DNA, 16 bp, Artificial sequence
  Synthetic oligonucleotide
ctgattattaatggtc

SEQ ID NO: 2475 - DNA, 16 bp, Artificial sequence
  Synthetic oligonucleotide
cctagttcgcagagtc

SEQ ID NO: 2476 - DNA, 16 bp, Artificial sequence
  Synthetic oligonucleotide
cacctagttcgcagag

SEQ ID NO: 2477 - DNA, 16 bp, Artificial sequence
  Synthetic oligonucleotide
ctcacctagttcgcag

SEQ ID NO: 2478 - DNA, 16 bp, Artificial sequence
  Synthetic oligonucleotide
ttcccaggagggtatg

SEQ ID NO: 2479 - DNA, 16 bp, Artificial sequence
  Synthetic oligonucleotide
cccccagggaatgccc

SEQ ID NO: 2480 - DNA, 16 bp, Artificial sequence
  Synthetic oligonucleotide
aacccccagggaatgc

SEQ ID NO: 2481 - DNA, 16 bp, Artificial sequence
  Synthetic oligonucleotide
gaacccccagggaatg

SEQ ID NO: 2482 - DNA, 16 bp, Artificial sequence
  Synthetic oligonucleotide
tggaagggaaccccca

SEQ ID NO: 2483 - DNA, 16 bp, Artificial sequence
  Synthetic oligonucleotide
gccacacacctcaacg

SEQ ID NO: 2484 - DNA, 16 bp, Artificial sequence
  Synthetic oligonucleotide
ctcggccacacacctc

SEQ ID NO: 2485 - DNA, 16 bp, Artificial sequence
  Synthetic oligonucleotide
aagaggccgcctggcg

SEQ ID NO: 2486 - DNA, 16 bp, Artificial sequence
  Synthetic oligonucleotide
aaaagaggccgcctgg

SEQ ID NO: 2487 - DNA, 16 bp, Artificial sequence
  Synthetic oligonucleotide
caaaagaggccgcctg

SEQ ID NO: 2488 - DNA, 16 bp, Artificial sequence
  Synthetic oligonucleotide
acaaaagaggccgcct

SEQ ID NO: 2489 - DNA, 16 bp, Artificial sequence
  Synthetic oligonucleotide
tagctgtcagataaac

SEQ ID NO: 2490 - DNA, 16 bp, Artificial sequence
  Synthetic oligonucleotide
atatttagctgtcaga

SEQ ID NO: 2491 - DNA, 16 bp, Artificial sequence
  Synthetic oligonucleotide
tgatatttagctgtca

SEQ ID NO: 2492 - DNA, 16 bp, Artificial sequence
  Synthetic oligonucleotide
ttgatatttagctgtc

SEQ ID NO: 2493 - DNA, 16 bp, Artificial sequence
  Synthetic oligonucleotide
gtgattgccttgatat

SEQ ID NO: 2494 - DNA, 16 bp, Artificial sequence
  Synthetic oligonucleotide
cggtgattgccttgat

SEQ ID NO: 2495 - DNA, 16 bp, Artificial sequence
  Synthetic oligonucleotide
ggcggtgattgccttg

SEQ ID NO: 2496 - DNA, 16 bp, Artificial sequence
  Synthetic oligonucleotide
aggcggtgattgcctt

SEQ ID NO: 2497 - DNA, 16 bp, Artificial sequence
  Synthetic oligonucleotide
gaggcggtgattgcct

SEQ ID NO: 2498 - DNA, 16 bp, Artificial sequence
  Synthetic oligonucleotide
cgaggcggtgattgcc

SEQ ID NO: 2499 - DNA, 16 bp, Artificial sequence
  Synthetic oligonucleotide
ccgcgaggcggtgatt

SEQ ID NO: 2500 - DNA, 16 bp, Artificial sequence
  Synthetic oligonucleotide
gccgcgaggcggtgat

SEQ ID NO: 2501 - DNA, 16 bp, Artificial sequence
  Synthetic oligonucleotide
ggccgcgaggcggtga

SEQ ID NO: 2502 - DNA, 16 bp, Artificial sequence
  Synthetic oligonucleotide
gggccgcgaggcggtg

SEQ ID NO: 2503 - DNA, 16 bp, Artificial sequence
  Synthetic oligonucleotide
agggccgcgaggcggt

SEQ ID NO: 2504 - DNA, 16 bp, Artificial sequence
  Synthetic oligonucleotide
gcagggccgcgaggcg

SEQ ID NO: 2505 - DNA, 16 bp, Artificial sequence
  Synthetic oligonucleotide
ggcagggccgcgaggc

SEQ ID NO: 2506 - DNA, 16 bp, Artificial sequence
  Synthetic oligonucleotide
ggaggcagggccgcga

SEQ ID NO: 2507 - DNA, 16 bp, Artificial sequence
  Synthetic oligonucleotide
tggaggcagggccgcg

SEQ ID NO: 2508 - DNA, 16 bp, Artificial sequence
  Synthetic oligonucleotide
tttgtcttagctgtgg

SEQ ID NO: 2509 - DNA, 16 bp, Artificial sequence
  Synthetic oligonucleotide
gtttgtcttagctgtg

SEQ ID NO: 2510 - DNA, 16 bp, Artificial sequence
  Synthetic oligonucleotide
tgtttgtcttagctgt

SEQ ID NO: 2511 - DNA, 16 bp, Artificial sequence
  Synthetic oligonucleotide
ctgtttgtcttagctg

SEQ ID NO: 2512 - DNA, 16 bp, Artificial sequence
  Synthetic oligonucleotide
actgtttgtcttagct

SEQ ID NO: 2513 - DNA, 16 bp, Artificial sequence
  Synthetic oligonucleotide
gcccaactgtttgtct

SEQ ID NO: 2514 - DNA, 16 bp, Artificial sequence
  Synthetic oligonucleotide
tagcccaactgtttgt

SEQ ID NO: 2515 - DNA, 16 bp, Artificial sequence
  Synthetic oligonucleotide
ggcattcttttagccc

SEQ ID NO: 2516 - DNA, 16 bp, Artificial sequence
  Synthetic oligonucleotide
taaaggcccagccatg

SEQ ID NO: 2517 - DNA, 16 bp, Artificial sequence
  Synthetic oligonucleotide
ctcaccagttggtttg

SEQ ID NO: 2518 - DNA, 16 bp, Artificial sequence
  Synthetic oligonucleotide
actcaccagttggttt

SEQ ID NO: 2519 - DNA, 16 bp, Artificial sequence
  Synthetic oligonucleotide
ctactcaccagttggt

SEQ ID NO: 2520 - DNA, 16 bp, Artificial sequence
  Synthetic oligonucleotide
tagaggctctatttct

SEQ ID NO: 2521 - DNA, 16 bp, Artificial sequence
  Synthetic oligonucleotide
gtgttaaagctgagcc

SEQ ID NO: 2522 - DNA, 16 bp, Artificial sequence
  Synthetic oligonucleotide
gtctcaaatgggcttc

SEQ ID NO: 2523 - DNA, 16 bp, Artificial sequence
  Synthetic oligonucleotide
ccagtctcaaatgggc

SEQ ID NO: 2524 - DNA, 16 bp, Artificial sequence
  Synthetic oligonucleotide
gccagtctcaaatggg

SEQ ID NO: 2525 - DNA, 16 bp, Artificial sequence
  Synthetic oligonucleotide
gtgccagtctcaaatg

SEQ ID NO: 2526 - DNA, 16 bp, Artificial sequence
  Synthetic oligonucleotide
ggtgccagtctcaaat

SEQ ID NO: 2527 - DNA, 16 bp, Artificial sequence
  Synthetic oligonucleotide
gctggtgccagtctca

SEQ ID NO: 2528 - DNA, 16 bp, Artificial sequence
  Synthetic oligonucleotide
ggtgcccaacccttca

SEQ ID NO: 2529 - DNA, 16 bp, Artificial sequence
  Synthetic oligonucleotide
aggcggaaggacttgc

SEQ ID NO: 2530 - DNA, 16 bp, Artificial sequence
  Synthetic oligonucleotide
cccaacagccaaaacg

SEQ ID NO: 2531 - DNA, 16 bp, Artificial sequence
  Synthetic oligonucleotide
aggcccaacagccaaa

SEQ ID NO: 2532 - DNA, 16 bp, Artificial sequence
  Synthetic oligonucleotide
gaaaggcccaacagcc

SEQ ID NO: 2533 - DNA, 16 bp, Artificial sequence
  Synthetic oligonucleotide
gggaaaggcccaacag

SEQ ID NO: 2534 - DNA, 16 bp, Artificial sequence
  Synthetic oligonucleotide
ggctgcagagtatggg

SEQ ID NO: 2535 - DNA, 16 bp, Artificial sequence
  Synthetic oligonucleotide
tcacatgctttgcggg

SEQ ID NO: 2536 - DNA, 16 bp, Artificial sequence
  Synthetic oligonucleotide
tgtaaatcgaaagcaa

SEQ ID NO: 2537 - DNA, 16 bp, Artificial sequence
  Synthetic oligonucleotide
tttgtaaatcgaaagc

SEQ ID NO: 2538 - DNA, 16 bp, Artificial sequence
  Synthetic oligonucleotide
ttttgtaaatcgaaag

SEQ ID NO: 2539 - DNA, 16 bp, Artificial sequence
  Synthetic oligonucleotide
aaccatttatctggtg

SEQ ID NO: 2540 - DNA, 16 bp, Artificial sequence
  Synthetic oligonucleotide
cagtcaagttacagtc

SEQ ID NO: 2541 - DNA, 16 bp, Artificial sequence
  Synthetic oligonucleotide
tcactccactcaccga

SEQ ID NO: 2542 - DNA, 16 bp, Artificial sequence
  Synthetic oligonucleotide
acctaatgtcaacact

SEQ ID NO: 2543 - DNA, 16 bp, Artificial sequence
  Synthetic oligonucleotide
tacctaatgtcaacac

SEQ ID NO: 2544 - DNA, 16 bp, Artificial sequence
  Synthetic oligonucleotide
gctacctaatgtcaac

SEQ ID NO: 2545 - DNA, 16 bp, Artificial sequence
  Synthetic oligonucleotide
tcccccttggaaatgg

SEQ ID NO: 2546 - DNA, 16 bp, Artificial sequence
  Synthetic oligonucleotide
ggctgatctggagaac

SEQ ID NO: 2547 - DNA, 16 bp, Artificial sequence
  Synthetic oligonucleotide
attggctgatctggag

SEQ ID NO: 2548 - DNA, 16 bp, Artificial sequence
  Synthetic oligonucleotide
tattggctgatctgga

SEQ ID NO: 2549 - DNA, 16 bp, Artificial sequence
  Synthetic oligonucleotide
ctattggctgatctgg

SEQ ID NO: 2550 - DNA, 16 bp, Artificial sequence
  Synthetic oligonucleotide
cctattggctgatctg

SEQ ID NO: 2551 - DNA, 16 bp, Artificial sequence
  Synthetic oligonucleotide
ttcctattggctgatc

SEQ ID NO: 2552 - DNA, 16 bp, Artificial sequence
  Synthetic oligonucleotide
cacttcctattggctg

SEQ ID NO: 2553 - DNA, 16 bp, Artificial sequence
  Synthetic oligonucleotide
tcacttcctattggct

SEQ ID NO: 2554 - DNA, 16 bp, Artificial sequence
  Synthetic oligonucleotide
caggttaatcacttcc

SEQ ID NO: 2555 - DNA, 16 bp, Artificial sequence
  Synthetic oligonucleotide
ttggcaggttaatcac

SEQ ID NO: 2556 - DNA, 16 bp, Artificial sequence
  Synthetic oligonucleotide
cgattggcaggttaat

SEQ ID NO: 2557 - DNA, 16 bp, Artificial sequence
  Synthetic oligonucleotide
ccgattggcaggttaa

SEQ ID NO: 2558 - DNA, 16 bp, Artificial sequence
  Synthetic oligonucleotide
tccgattggcaggtta

SEQ ID NO: 2559 - DNA, 16 bp, Artificial sequence
  Synthetic oligonucleotide
ttccgattggcaggtt

SEQ ID NO: 2560 - DNA, 16 bp, Artificial sequence
  Synthetic oligonucleotide
tttccgattggcaggt

SEQ ID NO: 2561 - DNA, 16 bp, Artificial sequence
  Synthetic oligonucleotide
gtttccgattggcagg

SEQ ID NO: 2562 - DNA, 16 bp, Artificial sequence
  Synthetic oligonucleotide
agtttccgattggcag

SEQ ID NO: 2563 - DNA, 16 bp, Artificial sequence
  Synthetic oligonucleotide
tagtttccgattggca

SEQ ID NO: 2564 - DNA, 16 bp, Artificial sequence
  Synthetic oligonucleotide
gagtaaccagctgtct

SEQ ID NO: 2565 - DNA, 16 bp, Artificial sequence
  Synthetic oligonucleotide
gggtgagtaaccagct

SEQ ID NO: 2566 - DNA, 16 bp, Artificial sequence
  Synthetic oligonucleotide
tgggtgagtaaccagc

SEQ ID NO: 2567 - DNA, 16 bp, Artificial sequence
  Synthetic oligonucleotide
ttgggtgagtaaccag

SEQ ID NO: 2568 - DNA, 16 bp, Artificial sequence
  Synthetic oligonucleotide
gttttgggtgagtaac

SEQ ID NO: 2569 - DNA, 16 bp, Artificial sequence
  Synthetic oligonucleotide
cgttttgggtgagtaa

SEQ ID NO: 2570 - DNA, 16 bp, Artificial sequence
  Synthetic oligonucleotide
ggtaggcacatcatca

SEQ ID NO: 2571 - DNA, 16 bp, Artificial sequence
  Synthetic oligonucleotide
gggccacccagtgagc

SEQ ID NO: 2572 - DNA, 16 bp, Artificial sequence
  Synthetic oligonucleotide
taccacccctgtgaag

SEQ ID NO: 2573 - DNA, 16 bp, Artificial sequence
  Synthetic oligonucleotide
ctaccacccctgtgaa

SEQ ID NO: 2574 - DNA, 16 bp, Artificial sequence
  Synthetic oligonucleotide
cctaccacccctgtga

SEQ ID NO: 2575 - DNA, 16 bp, Artificial sequence
  Synthetic oligonucleotide
tccctaccacccctgt

SEQ ID NO: 2576 - DNA, 16 bp, Artificial sequence
  Synthetic oligonucleotide
atggtgctctgccctt

SEQ ID NO: 2577 - DNA, 16 bp, Artificial sequence
  Synthetic oligonucleotide
aatggtgctctgccct

SEQ ID NO: 2578 - DNA, 16 bp, Artificial sequence
  Synthetic oligonucleotide
aaatggtgctctgccc

SEQ ID NO: 2579 - DNA, 16 bp, Artificial sequence
  Synthetic oligonucleotide
gaaatggtgctctgcc

SEQ ID NO: 2580 - DNA, 16 bp, Artificial sequence
  Synthetic oligonucleotide
gtgaaatggtgctctg

SEQ ID NO: 2581 - DNA, 16 bp, Artificial sequence
  Synthetic oligonucleotide
aaggtaagccagctcc

SEQ ID NO: 2582 - DNA, 16 bp, Artificial sequence
  Synthetic oligonucleotide
aaaggtaagccagctc

SEQ ID NO: 2583 - DNA, 16 bp, Artificial sequence
  Synthetic oligonucleotide
tcaaaggtaagccagc

SEQ ID NO: 2584 - DNA, 16 bp, Artificial sequence
  Synthetic oligonucleotide
atcaaaggtaagccag

SEQ ID NO: 2585 - DNA, 16 bp, Artificial sequence
  Synthetic oligonucleotide
tcagatcaaaggtaag

SEQ ID NO: 2586 - DNA, 16 bp, Artificial sequence
  Synthetic oligonucleotide
ctcagatcaaaggtaa

SEQ ID NO: 2587 - DNA, 16 bp, Artificial sequence
  Synthetic oligonucleotide
tcagggtgtcagccca

SEQ ID NO: 2588 - DNA, 16 bp, Artificial sequence
  Synthetic oligonucleotide
cacattcagggtgtca

SEQ ID NO: 2589 - DNA, 16 bp, Artificial sequence
  Synthetic oligonucleotide
ccacattcagggtgtc

SEQ ID NO: 2590 - DNA, 16 bp, Artificial sequence
  Synthetic oligonucleotide
accacattcagggtgt

SEQ ID NO: 2591 - DNA, 16 bp, Artificial sequence
  Synthetic oligonucleotide
ataccctgcactttct

SEQ ID NO: 2592 - DNA, 16 bp, Artificial sequence
  Synthetic oligonucleotide
tataccctgcactttc

SEQ ID NO: 2593 - DNA, 16 bp, Artificial sequence
  Synthetic oligonucleotide
gtgtataccctgcact

SEQ ID NO: 2594 - DNA, 16 bp, Artificial sequence
  Synthetic oligonucleotide
ggtgtataccctgcac

SEQ ID NO: 2595 - DNA, 16 bp, Artificial sequence
  Synthetic oligonucleotide
atggtgtataccctgc

SEQ ID NO: 2596 - DNA, 16 bp, Artificial sequence
  Synthetic oligonucleotide
gatacacttaatcaaa

SEQ ID NO: 2597 - DNA, 16 bp, Artificial sequence
  Synthetic oligonucleotide
caggatacacttaatc

SEQ ID NO: 2598 - DNA, 16 bp, Artificial sequence
  Synthetic oligonucleotide
tttacaggatacactt

SEQ ID NO: 2599 - DNA, 16 bp, Artificial sequence
  Synthetic oligonucleotide
ttttacaggatacact

SEQ ID NO: 2600 - DNA, 16 bp, Artificial sequence
  Synthetic oligonucleotide
gttttacaggatacac

SEQ ID NO: 2601 - DNA, 16 bp, Artificial sequence
  Synthetic oligonucleotide
aagaccctgtaagctt

SEQ ID NO: 2602 - DNA, 16 bp, Artificial sequence
  Synthetic oligonucleotide
atacacaagaccctgt

SEQ ID NO: 2603 - DNA, 16 bp, Artificial sequence
  Synthetic oligonucleotide
aatacacaagaccctg

SEQ ID NO: 2604 - DNA, 16 bp, Artificial sequence
  Synthetic oligonucleotide
attagtcccatgaaac

SEQ ID NO: 2605 - DNA, 16 bp, Artificial sequence
  Synthetic oligonucleotide
ctcattagtcccatga

SEQ ID NO: 2606 - DNA, 16 bp, Artificial sequence
  Synthetic oligonucleotide
tcttacctgaaagccc

SEQ ID NO: 2607 - DNA, 16 bp, Artificial sequence
  Synthetic oligonucleotide
tgagtaaacaataccc

SEQ ID NO: 2608 - DNA, 16 bp, Artificial sequence
  Synthetic oligonucleotide
aacaacatcctgagcg

SEQ ID NO: 2609 - DNA, 16 bp, Artificial sequence
  Synthetic oligonucleotide
ccatctaacaacatcc

SEQ ID NO: 2610 - DNA, 16 bp, Artificial sequence
  Synthetic oligonucleotide
agacaaaccttccgaa

SEQ ID NO: 2611 - DNA, 16 bp, Artificial sequence
  Synthetic oligonucleotide
gcctttggaattagta

SEQ ID NO: 2612 - DNA, 16 bp, Artificial sequence
  Synthetic oligonucleotide
ggagctcaaactttga

SEQ ID NO: 2613 - DNA, 16 bp, Artificial sequence
  Synthetic oligonucleotide
gcccgctctcagccag

SEQ ID NO: 2614 - DNA, 16 bp, Artificial sequence
  Synthetic oligonucleotide
agcccgctctcagcca

SEQ ID NO: 2615 - DNA, 16 bp, Artificial sequence
  Synthetic oligonucleotide
aagcccgctctcagcc

SEQ ID NO: 2616 - DNA, 16 bp, Artificial sequence
  Synthetic oligonucleotide
taagcccgctctcagc

SEQ ID NO: 2617 - DNA, 16 bp, Artificial sequence
  Synthetic oligonucleotide
ttaagcccgctctcag

SEQ ID NO: 2618 - DNA, 16 bp, Artificial sequence
  Synthetic oligonucleotide
cattaagcccgctctc

SEQ ID NO: 2619 - DNA, 16 bp, Artificial sequence
  Synthetic oligonucleotide
tcattaagcccgctct

SEQ ID NO: 2620 - DNA, 16 bp, Artificial sequence
  Synthetic oligonucleotide
ttcattaagcccgctc

SEQ ID NO: 2621 - DNA, 16 bp, Artificial sequence
  Synthetic oligonucleotide
attcattaagcccgct

SEQ ID NO: 2622 - DNA, 16 bp, Artificial sequence
  Synthetic oligonucleotide
ccattcattaagcccg

SEQ ID NO: 2623 - DNA, 16 bp, Artificial sequence
  Synthetic oligonucleotide
cccattcattaagccc

SEQ ID NO: 2624 - DNA, 16 bp, Artificial sequence
  Synthetic oligonucleotide
gccccattcattaagc

SEQ ID NO: 2625 - DNA, 16 bp, Artificial sequence
  Synthetic oligonucleotide
agccccattcattaag

SEQ ID NO: 2626 - DNA, 16 bp, Artificial sequence
  Synthetic oligonucleotide
gagccccattcattaa

SEQ ID NO: 2627 - DNA, 16 bp, Artificial sequence
  Synthetic oligonucleotide
accctaaactgagccc

SEQ ID NO: 2628 - DNA, 16 bp, Artificial sequence
  Synthetic oligonucleotide
caccctaaactgagcc

SEQ ID NO: 2629 - DNA, 16 bp, Artificial sequence
  Synthetic oligonucleotide
ccaccctaaactgagc

SEQ ID NO: 2630 - DNA, 16 bp, Artificial sequence
  Synthetic oligonucleotide
tcccaccctaaactga

SEQ ID NO: 2631 - DNA, 16 bp, Artificial sequence
  Synthetic oligonucleotide
ccgaccttcctcccac

SEQ ID NO: 2632 - DNA, 16 bp, Artificial sequence
  Synthetic oligonucleotide
gccgaccttcctccca

SEQ ID NO: 2633 - DNA, 16 bp, Artificial sequence
  Synthetic oligonucleotide
agaatcaagccctggc

SEQ ID NO: 2634 - DNA, 16 bp, Artificial sequence
  Synthetic oligonucleotide
gagaatcaagccctgg

SEQ ID NO: 2635 - DNA, 16 bp, Artificial sequence
  Synthetic oligonucleotide
ggcaccacattttcac

SEQ ID NO: 2636 - DNA, 16 bp, Artificial sequence
  Synthetic oligonucleotide
ccgaggcaccacattt

SEQ ID NO: 2637 - DNA, 16 bp, Artificial sequence
  Synthetic oligonucleotide
tccgaggcaccacatt

SEQ ID NO: 2638 - DNA, 16 bp, Artificial sequence
  Synthetic oligonucleotide
ctccgaggcaccacat

SEQ ID NO: 2639 - DNA, 16 bp, Artificial sequence
  Synthetic oligonucleotide
cctccgaggcaccaca

SEQ ID NO: 2640 - DNA, 16 bp, Artificial sequence
  Synthetic oligonucleotide
acctccgaggcaccac

SEQ ID NO: 2641 - DNA, 16 bp, Artificial sequence
  Synthetic oligonucleotide
cacctccgaggcacca

SEQ ID NO: 2642 - DNA, 16 bp, Artificial sequence
  Synthetic oligonucleotide
ccacctccgaggcacc

SEQ ID NO: 2643 - DNA, 16 bp, Artificial sequence
  Synthetic oligonucleotide
cccacctccgaggcac

SEQ ID NO: 2644 - DNA, 16 bp, Artificial sequence
  Synthetic oligonucleotide
tacccgcccactcccc

SEQ ID NO: 2645 - DNA, 16 bp, Artificial sequence
  Synthetic oligonucleotide
acaatctcctggaagc

SEQ ID NO: 2646 - DNA, 16 bp, Artificial sequence
  Synthetic oligonucleotide
agtacaatctcctgga

SEQ ID NO: 2647 - DNA, 16 bp, Artificial sequence
  Synthetic oligonucleotide
aagtacaatctcctgg

SEQ ID NO: 2648 - DNA, 16 bp, Artificial sequence
  Synthetic oligonucleotide
gaaagtacaatctcct

SEQ ID NO: 2649 - DNA, 16 bp, Artificial sequence
  Synthetic oligonucleotide
atgaaagtacaatctc

SEQ ID NO: 2650 - DNA, 16 bp, Artificial sequence
  Synthetic oligonucleotide
ggagttgcatgccttt

SEQ ID NO: 2651 - DNA, 16 bp, Artificial sequence
  Synthetic oligonucleotide
tggagttgcatgcctt

SEQ ID NO: 2652 - DNA, 16 bp, Artificial sequence
  Synthetic oligonucleotide
tcctaagctacttggt

SEQ ID NO: 2653 - DNA, 16 bp, Artificial sequence
  Synthetic oligonucleotide
ggcattagagacctca

SEQ ID NO: 2654 - DNA, 16 bp, Artificial sequence
  Synthetic oligonucleotide
tgtgcaccaggtgagc

SEQ ID NO: 2655 - DNA, 16 bp, Artificial sequence
  Synthetic oligonucleotide
ggtgtgcaccaggtga

SEQ ID NO: 2656 - DNA, 16 bp, Artificial sequence
  Synthetic oligonucleotide
gggtgtgcaccaggtg

SEQ ID NO: 2657 - DNA, 16 bp, Artificial sequence
  Synthetic oligonucleotide
tgggtgtgcaccaggt

SEQ ID NO: 2658 - DNA, 16 bp, Artificial sequence
  Synthetic oligonucleotide
tggtcttcaccagggt

SEQ ID NO: 2659 - DNA, 16 bp, Artificial sequence
  Synthetic oligonucleotide
gactggtcttcaccag

SEQ ID NO: 2660 - DNA, 16 bp, Artificial sequence
  Synthetic oligonucleotide
ggactggtcttcacca

SEQ ID NO: 2661 - DNA, 16 bp, Artificial sequence
  Synthetic oligonucleotide
aggactggtcttcacc

SEQ ID NO: 2662 - DNA, 16 bp, Artificial sequence
  Synthetic oligonucleotide
cagtggtgacctccct

SEQ ID NO: 2663 - DNA, 16 bp, Artificial sequence
  Synthetic oligonucleotide
gccagtggtgacctcc

SEQ ID NO: 2664 - DNA, 16 bp, Artificial sequence
  Synthetic oligonucleotide
cccggagaggaagcct

SEQ ID NO: 2665 - DNA, 16 bp, Artificial sequence
  Synthetic oligonucleotide
gcctcagcagttaata

SEQ ID NO: 2666 - DNA, 16 bp, Artificial sequence
  Synthetic oligonucleotide
gtgcctcagcagttaa

SEQ ID NO: 2667 - DNA, 16 bp, Artificial sequence
  Synthetic oligonucleotide
tgtgcctcagcagtta

SEQ ID NO: 2668 - DNA, 16 bp, Artificial sequence
  Synthetic oligonucleotide
ctgtgcctcagcagtt

SEQ ID NO: 2669 - DNA, 16 bp, Artificial sequence
  Synthetic oligonucleotide
gaactgtgcctcagca

SEQ ID NO: 2670 - DNA, 16 bp, Artificial sequence
  Synthetic oligonucleotide
aattgagaactgtgcc

SEQ ID NO: 2671 - DNA, 16 bp, Artificial sequence
  Synthetic oligonucleotide
ccactaaattgagaac

SEQ ID NO: 2672 - DNA, 16 bp, Artificial sequence
  Synthetic oligonucleotide
tggtgtgttaaccact

SEQ ID NO: 2673 - DNA, 16 bp, Artificial sequence
  Synthetic oligonucleotide
aggtgaaagttatcac

SEQ ID NO: 2674 - DNA, 16 bp, Artificial sequence
  Synthetic oligonucleotide
acaaggtgaaagttat

SEQ ID NO: 2675 - DNA, 16 bp, Artificial sequence
  Synthetic oligonucleotide
caactgaaggtgaccc

SEQ ID NO: 2676 - DNA, 16 bp, Artificial sequence
  Synthetic oligonucleotide
gctgcttggccttacc

SEQ ID NO: 2677 - DNA, 16 bp, Artificial sequence
  Synthetic oligonucleotide
acagctgtaccagggc

SEQ ID NO: 2678 - DNA, 16 bp, Artificial sequence
  Synthetic oligonucleotide
cacagctgtaccaggg

SEQ ID NO: 2679 - DNA, 16 bp, Artificial sequence
  Synthetic oligonucleotide
tttacacaccccaggg

SEQ ID NO: 2680 - DNA, 16 bp, Artificial sequence
  Synthetic oligonucleotide
atgcttttacacaccc

SEQ ID NO: 2681 - DNA, 16 bp, Artificial sequence
  Synthetic oligonucleotide
ctctgtttggacaagt

SEQ ID NO: 2682 - DNA, 16 bp, Artificial sequence
  Synthetic oligonucleotide
gctctgtttggacaag

SEQ ID NO: 2683 - DNA, 16 bp, Artificial sequence
  Synthetic oligonucleotide
tgctctgtttggacaa

SEQ ID NO: 2684 - DNA, 16 bp, Artificial sequence
  Synthetic oligonucleotide
ctgctctgtttggaca

SEQ ID NO: 2685 - DNA, 16 bp, Artificial sequence
  Synthetic oligonucleotide
agaggtgtttccaagg

SEQ ID NO: 2686 - DNA, 16 bp, Artificial sequence
  Synthetic oligonucleotide
gagaggtgtttccaag

SEQ ID NO: 2687 - DNA, 16 bp, Artificial sequence
  Synthetic oligonucleotide
tctcaacagaccacac

SEQ ID NO: 2688 - DNA, 16 bp, Artificial sequence
  Synthetic oligonucleotide
attctcaacagaccac

SEQ ID NO: 2689 - DNA, 16 bp, Artificial sequence
  Synthetic oligonucleotide
cagccctttcacccct

SEQ ID NO: 2690 - DNA, 16 bp, Artificial sequence
  Synthetic oligonucleotide
acgacagcctggagac

SEQ ID NO: 2691 - DNA, 16 bp, Artificial sequence
  Synthetic oligonucleotide
tttactgcattccggc

SEQ ID NO: 2692 - DNA, 16 bp, Artificial sequence
  Synthetic oligonucleotide
cgtgtacccagctgcc

SEQ ID NO: 2693 - DNA, 16 bp, Artificial sequence
  Synthetic oligonucleotide
gcggcttcctgtgccc

SEQ ID NO: 2694 - DNA, 16 bp, Artificial sequence
  Synthetic oligonucleotide
gtgtccttcagaacac

SEQ ID NO: 2695 - DNA, 16 bp, Artificial sequence
  Synthetic oligonucleotide
cggttgcctcatcctg

SEQ ID NO: 2696 - DNA, 16 bp, Artificial sequence
  Synthetic oligonucleotide
acggttgcctcatcct

SEQ ID NO: 2697 - DNA, 16 bp, Artificial sequence
  Synthetic oligonucleotide
gccaccaacggttgcc

SEQ ID NO: 2698 - DNA, 16 bp, Artificial sequence
  Synthetic oligonucleotide
aggtccagggtcctcc

SEQ ID NO: 2699 - DNA, 16 bp, Artificial sequence
  Synthetic oligonucleotide
attaccctgctcatga

SEQ ID NO: 2700 - DNA, 16 bp, Artificial sequence
  Synthetic oligonucleotide
ccacttagcaaggagc

SEQ ID NO: 2701 - DNA, 16 bp, Artificial sequence
  Synthetic oligonucleotide
ttggagcaacaccaga

SEQ ID NO: 2702 - DNA, 16 bp, Artificial sequence
  Synthetic oligonucleotide
taatcagatgcctgct

SEQ ID NO: 2703 - DNA, 16 bp, Artificial sequence
  Synthetic oligonucleotide
ctaatcagatgcctgc

SEQ ID NO: 2704 - DNA, 16 bp, Artificial sequence
  Synthetic oligonucleotide
actaatcagatgcctg

SEQ ID NO: 2705 - DNA, 16 bp, Artificial sequence
  Synthetic oligonucleotide
cttttccggtattttc

SEQ ID NO: 2706 - DNA, 16 bp, Artificial sequence
  Synthetic oligonucleotide
ccttttccggtatttt

SEQ ID NO: 2707 - DNA, 16 bp, Artificial sequence
  Synthetic oligonucleotide
aaccttttccggtatt

SEQ ID NO: 2708 - DNA, 16 bp, Artificial sequence
  Synthetic oligonucleotide
ttaatggcccagccca

SEQ ID NO: 2709 - DNA, 16 bp, Artificial sequence
  Synthetic oligonucleotide
gttaatggcccagccc

SEQ ID NO: 2710 - DNA, 16 bp, Artificial sequence
  Synthetic oligonucleotide
aggctacaccaaagac

SEQ ID NO: 2711 - DNA, 16 bp, Artificial sequence
  Synthetic oligonucleotide
aaggctacaccaaaga

SEQ ID NO: 2712 - DNA, 16 bp, Artificial sequence
  Synthetic oligonucleotide
gaaggctacaccaaag

SEQ ID NO: 2713 - DNA, 16 bp, Artificial sequence
  Synthetic oligonucleotide
ctgaaggctacaccaa

SEQ ID NO: 2714 - DNA, 16 bp, Artificial sequence
  Synthetic oligonucleotide
tctgaaggctacacca

SEQ ID NO: 2715 - DNA, 16 bp, Artificial sequence
  Synthetic oligonucleotide
gctctgaaggctacac

SEQ ID NO: 2716 - DNA, 16 bp, Artificial sequence
  Synthetic oligonucleotide
gtatccatcaactgct

SEQ ID NO: 2717 - DNA, 16 bp, Artificial sequence
  Synthetic oligonucleotide
gactcatcaggcattc

SEQ ID NO: 2718 - DNA, 16 bp, Artificial sequence
  Synthetic oligonucleotide
tgactcatcaggcatt

SEQ ID NO: 2719 - DNA, 16 bp, Artificial sequence
  Synthetic oligonucleotide
aggtgactcatcaggc

SEQ ID NO: 2720 - DNA, 16 bp, Artificial sequence
  Synthetic oligonucleotide
aaggtgactcatcagg

SEQ ID NO: 2721 - DNA, 16 bp, Artificial sequence
  Synthetic oligonucleotide
accggaagtcttgtat

SEQ ID NO: 2722 - DNA, 16 bp, Artificial sequence
  Synthetic oligonucleotide
gaccggaagtcttgta

SEQ ID NO: 2723 - DNA, 16 bp, Artificial sequence
  Synthetic oligonucleotide
agaccggaagtcttgt

SEQ ID NO: 2724 - DNA, 16 bp, Artificial sequence
  Synthetic oligonucleotide
gcagggtggagaccgg

SEQ ID NO: 2725 - DNA, 16 bp, Artificial sequence
  Synthetic oligonucleotide
agtcagttggtttgag

SEQ ID NO: 2726 - DNA, 16 bp, Artificial sequence
  Synthetic oligonucleotide
ggacagtcagttggtt

SEQ ID NO: 2727 - DNA, 16 bp, Artificial sequence
  Synthetic oligonucleotide
agcatctggacagtca

SEQ ID NO: 2728 - DNA, 16 bp, Artificial sequence
  Synthetic oligonucleotide
tcagttggtttgagaa

SEQ ID NO: 2729 - DNA, 16 bp, Artificial sequence
  Synthetic oligonucleotide
atctggacagtcagtt

SEQ ID NO: 2730 - DNA, 16 bp, Artificial sequence
  Synthetic oligonucleotide
tccagttcggccttcc

SEQ ID NO: 2731 - DNA, 16 bp, Artificial sequence
  Synthetic oligonucleotide
agactccagttcggcc

SEQ ID NO: 2732 - DNA, 16 bp, Artificial sequence
  Synthetic oligonucleotide
gtcagttggtttgaga

SEQ ID NO: 2733 - DNA, 16 bp, Artificial sequence
  Synthetic oligonucleotide
cagtcagttggtttga

SEQ ID NO: 2734 - DNA, 16 bp, Artificial sequence
  Synthetic oligonucleotide
gcatctggacagtcag

SEQ ID NO: 2735 - DNA, 16 bp, Artificial sequence
  Synthetic oligonucleotide
gggagactccagttcg

SEQ ID NO: 2736 - DNA, 21 bp, Artificial sequence
  Synthetic oligonucleotide
gtcgccccttctccccgcagc

SEQ ID NO: 2737 - DNA, 18 bp, Artificial sequence
  Primer
ctgacgcgggaagtggat

SEQ ID NO: 2738 - DNA, 20 bp, Artificial sequence
  Primer
tggcggacttgatgaagatg

SEQ ID NO: 2739 - DNA, 27 bp, Artificial sequence
  Probe
tgtgggtttacaaccgcagcagttacc

SEQ ID NO: 2740 - DNA, 21 bp, Artificial sequence
  Primer
ccgatggattttctcaaacca

SEQ ID NO: 2741 - DNA, 21 bp, Artificial sequence
  Primer
aattcgttccccctgtttcag

SEQ ID NO: 2742 - DNA, 26 bp, Artificial sequence
  Probe
actgtccagatgctgtgccttcctcc

SEQ ID NO: 2743 - DNA, 16 bp, Artificial Sequence
  Synthetic oligonucleotide
aatgaactgtatctcc

What is claimed:

1. A compound comprising a modified oligonucleotide 16 to 30 linked nucleosides in length, wherein the modified oligonucleotide has a nucleobase sequence comprising any one of SEQ ID NOs: 2537, 1456, or 2109, wherein the modified oligonucleotide comprises:
    a gap segment consisting of linked deoxynucleosides;
    a 5' wing segment consisting of linked nucleosides; and
    a 3' wing segment consisting of linked nucleosides;
    wherein the gap segment is positioned between the 5' wing segment and the 3' wing segment and wherein each nucleoside of each wing segment comprises a modified sugar.

2. The compound of claim 1, wherein the compound is single-stranded.

3. The compound of claim 1, wherein the compound is double-stranded.

4. The compound of claim 1, wherein the compound comprises ribonucleotides.

5. The compound of claim 1, wherein the compound comprises deoxyribonucleotides.

6. A compound comprising a modified oligonucleotide 16 linked nucleosides in length having a nucleobase sequence consisting of any one of SEQ ID NOs: 2537, 1456, or 2109, wherein the modified oligonucleotide comprises:
    a gap segment consisting of ten linked deoxynucleosides;
    a 5' wing segment consisting of three linked nucleosides; and
    a 3' wing segment consisting of three linked nucleosides;
    wherein the gap segment is positioned between the 5' wing segment and the 3' wing segment; wherein each nucleoside of the 5' wing segment and the 3' wing segment comprises a cEt sugar; wherein at least one internucleoside linkage is a phosphorothioate linkage; and wherein each cytosine is a 5-methylcytosine.

7. A compound comprising a modified oligonucleotide according to the following formula: Tks Tks Tks Gds Tds Ads Ads Ads Tds mCds Gds Ads Ads Aks Gks mCk (SEQ ID NO: 2537); wherein,
    A=an adenine,
    mC=a 5-methylcytosine
    G=a guanine,
    T=a thymine,
    k=a cEt modified sugar,
    d=a 2'-deoxynucleoside, and
    s=a phosphorothioate internucleoside linkage.

8. A compound according to the following formula:

(SEQ ID NO: 2537)

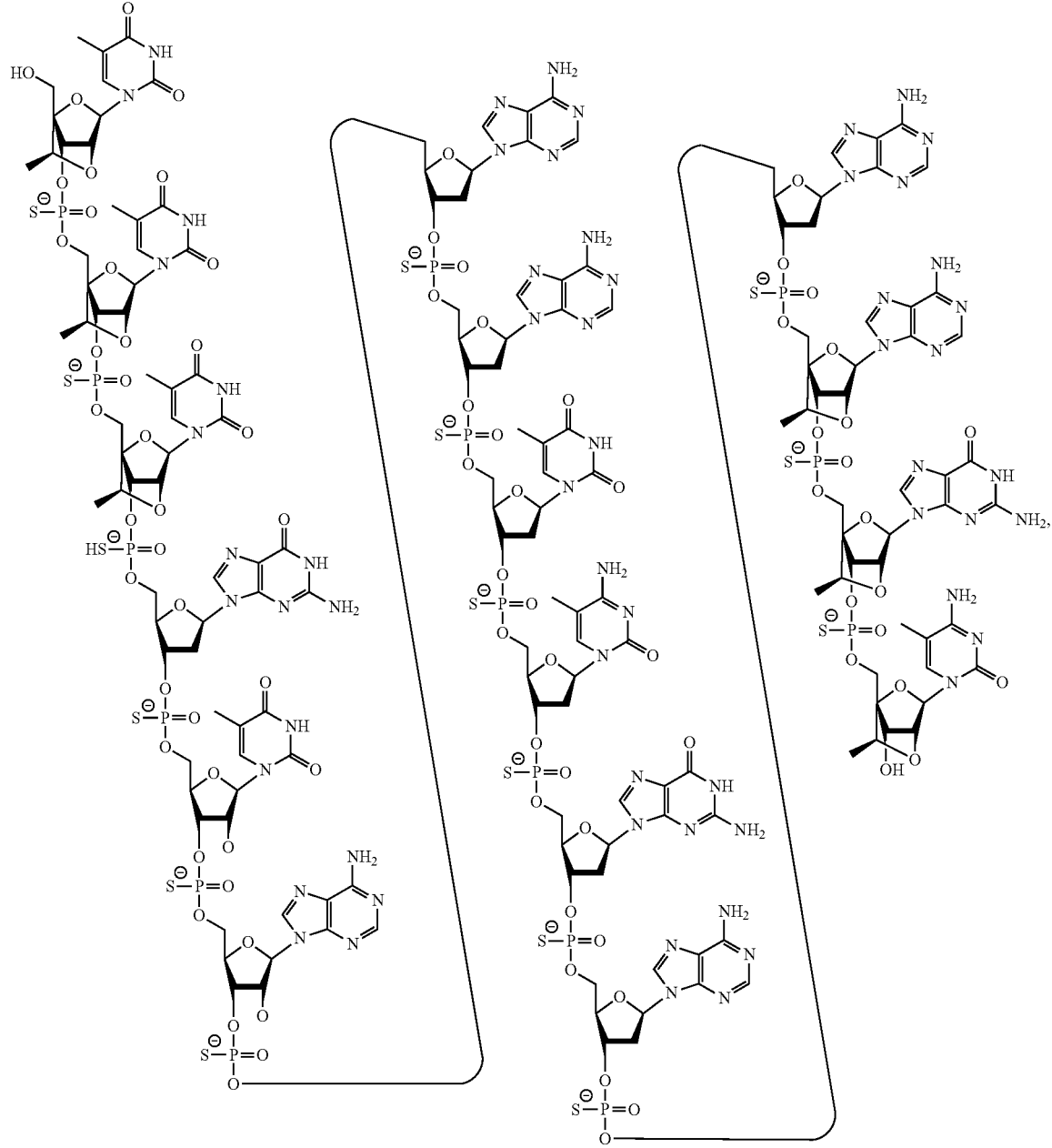

or a pharmaceutically acceptable salt thereof.

9. A modified oligonucleotide consisting of 16 linked nucleosides having the sequence of SEQ ID NO: 2537 and consisting of:
 a gap segment consisting of ten linked deoxynucleosides;
 a 5' wing segment consisting of three linked nucleosides; and
 a 3' wing segment consisting of three linked nucleosides;
 wherein the gap segment is positioned between the 5' wing segment and the 3' wing segment, wherein each nucleoside of each wing segment comprises a cEt sugar; wherein each internucleoside linkage is a phosphorothioate linkage; wherein each cytosine is a 5-methylcytosine.

10. The compound of claim 8, wherein the pharmaceutically acceptable salt is a sodium salt.

11. The compound of claim 8, wherein the pharmaceutically acceptable salt is a potassium salt.

12. A method of treating, preventing, or ameliorating a disease associated with SMAD7 in an individual comprising administering to the individual the compound of claim 8, thereby treating, preventing, or ameliorating the disease, wherein the disease is ulcerative colitis, Crohn's disease, inflammatory bowel disease, indeterminate colitis, familial adenomatous polyposis, intestinal GvHD, or cancer therapy-induced colitis.

13. The method of claim 12, wherein administering the compound inhibits, reduces, or improves inflammation in the gastrointestinal tract of the individual.

14. A method of inhibiting expression of SMAD7 in a cell comprising contacting the cell with the compound of claim 8, thereby inhibiting expression of SMAD7 in the cell, wherein the cell is in the gastrointestinal tract of an individual.

15. A method of reducing or inhibiting inflammation in the gastrointestinal tissues of an individual having, or at risk of having, a disease associated with SMAD7 comprising administering the compound of claim 8 to the individual, thereby reducing or inhibiting inflammation in the gastrointestinal tissues of the individual, wherein the individual has, or is at risk of having, ulcerative colitis, Crohn's disease, inflammatory bowel disease, indeterminate colitis, familial adenomatous polyposis, intestinal GvHD, or cancer therapy-induced colitis.

16. A method of treating, preventing, or ameliorating a disease associated with SMAD7 in an individual comprising administering to the individual the compound of claim 1, thereby treating, preventing, or ameliorating the disease, wherein the disease is ulcerative colitis, Crohn's disease, inflammatory bowel disease, indeterminate colitis, familial adenomatous polyposis, intestinal GvHD, or cancer therapy-induced colitis.

17. The method of claim 16, wherein administering the compound inhibits, reduces, or improves inflammation in the gastrointestinal tract of the individual.

18. A method of inhibiting expression of SMAD7 in a cell comprising contacting the cell with the compound of claim 1, thereby inhibiting expression of SMAD7 in the cell, wherein the cell is in the gastrointestinal tract of an individual.

19. A method of reducing or inhibiting inflammation in the gastrointestinal tissues of an individual having, or at risk of having, a disease associated with SMAD7 comprising administering the compound of claim 1 to the individual, thereby reducing or inhibiting inflammation in the gastrointestinal tissues of the individual, wherein the individual has, or is at risk of having, ulcerative colitis, Crohn's disease, inflammatory bowel disease, indeterminate colitis, familial adenomatous polyposis, intestinal GvHD, or cancer therapy-induced colitis.

20. A method of treating, preventing, or ameliorating a disease associated with SMAD7 in an individual comprising administering to the individual the compound of claim 6, thereby treating, preventing, or ameliorating the disease, wherein the disease is ulcerative colitis, Crohn's disease, inflammatory bowel disease, indeterminate colitis, familial adenomatous polyposis, intestinal GvHD, or cancer therapy-induced colitis.

21. The method of claim 20, wherein administering the compound inhibits, reduces, or improves inflammation in the gastrointestinal tract of the individual.

22. A method of inhibiting expression of SMAD7 in a cell comprising contacting the cell with the compound of claim 6, thereby inhibiting expression of SMAD7 in the cell, wherein the cell is in the gastrointestinal tract of an individual.

23. A method of reducing or inhibiting inflammation in the gastrointestinal tissues of an individual having, or at risk of having, a disease associated with SMAD7 comprising administering the compound of claim 6 to the individual, thereby reducing or inhibiting inflammation in the gastrointestinal tissues of the individual, wherein the individual has, or is at risk of having, ulcerative colitis, Crohn's disease, inflammatory bowel disease, indeterminate colitis, familial adenomatous polyposis, intestinal GvHD, or cancer therapy-induced colitis.

24. A composition comprising the compound of claim 8, and a pharmaceutically acceptable carrier.

25. A composition comprising the compound of claim 1, and a pharmaceutically acceptable carrier.

26. A composition comprising the compound of claim 6, and a pharmaceutically acceptable carrier.

* * * * *